US008765408B2

(12) United States Patent
Blattner et al.

(10) Patent No.: US 8,765,408 B2
(45) Date of Patent: Jul. 1, 2014

(54) PROPHAGE ELEMENT-FREE BACTERIA

(75) Inventors: Frederick R. Blattner, Madison, WI (US); John W. Campbell, Oak Park, IL (US); David Frisch, Fitchburg, WI (US); Guy Plunkett, III, Madison, WI (US); Gyorgy Posfai, Szeged (HU)

(73) Assignee: Wisconsin Alumni Research Foundation, Madison, WI (US)

( * ) Notice: Subject to any disclaimer, the term of this patent is extended or adjusted under 35 U.S.C. 154(b) by 123 days.

(21) Appl. No.: 13/363,848

(22) Filed: Feb. 1, 2012

(65) Prior Publication Data

US 2012/0219994 A1    Aug. 30, 2012

Related U.S. Application Data

(63) Continuation-in-part of application No. 11/400,711, filed on Apr. 7, 2006, now Pat. No. 8,119,365, which is a continuation-in-part of application No. 11/275,094, filed on Dec. 9, 2005, now Pat. No. 8,039,243, which is a continuation-in-part of application No. 10/896,739, filed on Jul. 22, 2004, now abandoned, which is a continuation of application No. PCT/US03/01800, filed on Jan. 22, 2003, which is a continuation-in-part of application No. 10/057,582, filed on Jan. 23, 2002, now Pat. No. 6,989,265.

(60) Provisional application No. 60/634,611, filed on Dec. 9, 2004, provisional application No. 60/409,089, filed on Sep. 6, 2002.

(51) Int. Cl.
   *C12P 21/06* (2006.01)
   *C12N 1/20* (2006.01)
   *C12N 1/21* (2006.01)

(52) U.S. Cl.
   USPC .................. 435/69.1; 435/252.33; 435/252.8

(58) Field of Classification Search
   None
   See application file for complete search history.

(56) References Cited

U.S. PATENT DOCUMENTS

| | | | | |
|---|---|---|---|---|
| 4,851,348 | A | 7/1989 | Hanahan | 435/6 |
| 4,981,797 | A | 1/1991 | Jessee et al. | 435/252.8 |
| 5,578,464 | A | 11/1996 | Lunn et al. | 435/69.1 |
| 5,747,662 | A | 5/1998 | Simmons et al. | 536/24.1 |
| 5,824,502 | A | 10/1998 | Honjo et al. | 435/69.1 |
| 5,962,327 | A | 10/1999 | Dujon et al. | 435/478 |
| 6,015,709 | A | 1/2000 | Natesan | 435/366 |
| 6,022,952 | A | 2/2000 | Weiner et al. | 530/350 |
| 6,117,680 | A | 9/2000 | Natesan et al. | 435/455 |
| 6,238,924 | B1 | 5/2001 | Dujon et al. | 435/477 |
| 6,335,178 | B1 | 1/2002 | Weiner et al. | 435/69.1 |
| 6,372,476 | B1 | 4/2002 | Belguith et al. | 435/233 |
| 6,410,273 | B1 | 6/2002 | Crouzet et al. | 435/91.1 |
| 6,509,156 | B1 | 1/2003 | Stewart et al. | 435/6 |
| 6,989,265 | B2 | 1/2006 | Blattner et al. | 435/252.8 |
| 8,039,243 | B2 | 10/2011 | Blattner | 435/252.8 |
| 8,119,365 | B2 | 2/2012 | Blattner et al. | 435/69.1 |
| 2003/0138937 | A1 | 7/2003 | Blattner et al. | 435/252.33 |
| 2005/0032225 | A1 | 2/2005 | Blattner et al. | 435/488 |

FOREIGN PATENT DOCUMENTS

| | | |
|---|---|---|
| EP | 0177343 | 4/1986 |
| EP | 0283726 | 9/1988 |
| WO | WO 88/05821 | 8/1988 |
| WO | WO 96/14408 | 5/1996 |
| WO | WO 01/27258 | 4/2001 |
| WO | WO 02/14495 | 2/2002 |
| WO | WO 03/048374 | 6/2003 |
| WO | WO 03/070880 | 8/2003 |
| WO | WO 2005/087940 | 9/2005 |
| WO | WO 2007/118162 | 10/2007 |

OTHER PUBLICATIONS

Aristidou et al., "Modification of central metabolic pathway in *Escherichia coli* to reduce acetate accumulation by heterologous expression of the bacillus subtilis acetolactate synthase gene," *Biotechnology and Bioengineering*, 44:944-951, 1994.
Asai et al., "An *Escherichia coli* strain with all chromosomal rRNA operons inactivated: complete exchange of rRNA genes between bacteria," *Proc. Natl. Acad. Sci., USA*, 96:1971-1976, 1999.
Balbas, "Understanding the art of producing protein and non-protein molecules in *E. coli*," *Molec Biotechnol.*, 19:251-267, 2001.
Baneyx, "Recombinant protein expression in *E. coli*," *Curr Opin Biotech*, 10:411-421, 1999.
Bass et al., "Mulitcopy suppressors of Prc mutant *Escherichia coli* include two HtrA (DegP) protease homologs (HhoAB), DksA, and a truncated R1pA," *Journal of Bacteriology*, 178(4):1154-1161, 1996.
Beaulieu et al., "Pathogenic behavior of pectinase-defective *Erwinia chrysanthemi* mutants on different plants," *MPMI*, 6(2):197-202, 1993.
Bermejo et al., "Expression of clostridium acetobutylicum ATCC 824 genes in *Escherichia coli* for acetone production and acetate detoxification," *Applied and Environmental Microbiology*, 64:1079-1085, 1998.
Berry et al., "Application of metabolic engineering to improve both production and use of biotech indigo," *J Indust Micro & Biotech*, 22:127-133, 2002.

(Continued)

*Primary Examiner* — Nancy T Vogel
(74) *Attorney, Agent, or Firm* — Parker Highlander PLLC

(57) ABSTRACT

The present invention provides a bacterium having a genome that is genetically engineered to be smaller than the genome of its native parent strain. A bacterium with a smaller genome can produce a commercial product more efficiently. The present invention also provides methods for deleting genes and other DNA sequences from a bacterial genome. The methods provide precise deletions and seldom introduces mutations to the genomic DNA sequences around the deletion sites. Thus, the methods can be used to generate a series of deletions in a bacterium without increasing the possibility of undesired homologous recombination within the genome. In addition, some of the methods provided by the present invention can also be used for replacing a region of a bacterial genome with a desired DNA sequence.

11 Claims, 10 Drawing Sheets

(56) References Cited

OTHER PUBLICATIONS

Blattner et al., "The complete genome sequence of *Escherichia coli* K-12," *Science*, 277:1453-1474, 1997.

Blaudeck et al., "Specificity of single peptide recognition in TAT-dependent bacterial protein translocation," *J. Bacteriology*, 183:604-610, 2001.

Chang et al., "Acetate metabolism in a pta mutant of *Escherichia coli* W3110: Importance of maintaining acetyl coenzyme a flux for growth and survival," *Journal of Bacteriology*, 181:6656-6663, 1999.

Chou et al., "Effect of modified glucose uptake using genetic engineering techniques on high-level recombinant protein production in *Escherichia coli* dense cultures," *Biotechnology and Bioengineering* 44:953-960, 1994.

Contiero et al., "Effects of mutations in acetate metabolism on high-cell-density growth of *Eschrichia coli*," *Journal of Industrial Microbiology & Biotechnology*, 24:421-430, 2000.

Court et al., "Genetic engineering using homologous recombination," *Annu Rev Genet*, 36:361-388, 2002.

Danese et al., "Targeting and assembly of periplasmic and outer-membrane proteins in *Escherichia coli*," *Annu Rev Genet*, 32:59-64, 1998.

Database EMBL, "*E.coli* genomic DNA, Kohara clone #421(55.1-55.5 min.)," Database Acession No. ECD874.

Datsenko and Wanner, "One-step inactivation of chromosomal genes in *Escherichia coli* K-12 using PCR products," *Proc. Natl. Acad. Sci. USA*, 97:6640-6645, 2000.

Dedhia et al., "Overproduction of glycogen in *Escherichia coli* blocked in the acetate pathway improved cell growth," *Biotechnology and Bioengineering*, 44:132-139, 1994.

Degryse, "Evaluation of *Escherichia coli* recBC sbcBC mutants for cloning by recombination in vivo," *J. Biotechnology*, 39:181-187, 1995.

DeLisa et al., "Quorum sensing via AI-2 communicates the metabolic burden associated with heterologous protein production in *E. coli*," *Biotech Bioeng*, 75(4):439-450, 2001.

Diaz-Ricci et al., "Effects of alteration of the acetic acid synthesis pathway on the fermentation pattern of *Escherichia coli*," *Biotechnology and Bioengineering*, 38:1318-1324, 1991.

Dykstra and Kushner, "Physical characterization of the cloned protease III gene from *Escherichia coli* K-12," *Journal of Bacteriology*, 163(3):1055-1059, 1985.

Eichhorn et al., "Deletion analysis of the *Escherichia coli* taurine and alkanesulfonate transport systems," *Journal of Bacteriology*, 182(10)2687-2695, 2000.

Farmer and Liao., "Reduction of aerobic acetate production by *Escherichia coli*," *Applied and Environmental Microbiology*, 63:3205-3210, 1997.

Fekkes and Driessen, "Protein targeting to the bacterial cytoplasmic membrane," *Microbiol. Mol. Biol. Rev.*, 63:161-193, 1999.

GenBank Accession No. AE014073, 2006.
GenBank Accession No. AE014075, 2006.
GenBank Accession No. AF348706, 2007.
GenBank Accession No. AP009048, 2008.
GenBank Accession No. U00096, 2006.

Gill et al., "A comparative study of global stress gene regulation in response to overexpression of recombinant proteins in *E. coli*," *Metabolic Engineering*, 2:178-189, 2000.

Hahm et al., "Characterization and evaluation of a pta (phoshotransacetylase) negative mutant of *Escherichia coli* HB101 as production host of foreign lipase," *Applied Microbiology and Biotechnology*, 42:100-107, 1994.

Hall, "Activation of the bgl operon by adaptive mutation," *Mol. Biol. Evol.*, 15:1-5, 1998.

Hanahan, "Studies on transformation of *Escherichia coli* with plasmids," *J. Mol. Biol.*, 166(4):557-580, 1983.

Hannig and Makrides, "Strategies for optimizing heterologous protein expression in *Escherichia coli*," *Trends Biotechnol.*, 16(2):54-60, 1998.

Hayashi et al., "Construction of a genetic linkage map of the model legume *Lotus japonicus* using an intraspecific F2 population," *DNA Research*, 8:11-22, 2001.

Hengen, "Better competent cells and DNA polymerase contaminants," *Trends in Biochem. Sci.*, 19:426-427, 1994.

Hengen, "Preparing ultra-competent *Escherichia coli*," *Trends in Biochem. Sci.*, 21:75-76, 1996.

Hockney, "Recent developments in heterologous protein production in *Escherichia coli*," *Trends Biotechnol.*, 12(11):456-632, 1994.

Holms, "Flux analysis and control of the central metabolic pathways in *Escherichia coli*," *FEMS Microbiology Reviews*, 19:85-116, 1996.

Holms, "The central metabolic pathways of *Escherichia coli*: relationship between flux and control at a branch point, efficiency of conversion to biomass, and excretion of acetate," *Current Topics in Cellular Regulation*, 28:69-105, 1986.

Hynds et al., "The sec-independent twin-arginine translocation system can transport both tightly folded and malfolded proteins across the thylakoid membrane," *J. Biol. Chem.*, 273:34868-34874, 1998.

Kakuda et al., "Construction of Pta-Ack pathway deletion mutants of *Escherichia coli* and characteristic growth profiles of the mutants in a rich medium," *Bioscience Biotechnology Biochemistry*, 58:2232-2235, 1994.

Khosla et al., "Expression of Recombinant Proteins in *Escherichia coli* Using an Oxygen-Responsive Promoter," *Bio/Technology*, 8:554-558, 1990.

Kitamura et al., "DNA sequence changes in mutations in the ton B gene on the chromosome of *Escherichia coli* K-12: insertion elements dominate the spontaneous spectra,," *Jpn J. Genet*, 70:35-46, 1995.

Kolisnychenko et al., "Engineering a reduced *Escherichia coli* genome," *Genome Research*, 12:640-647, 2002.

Koob et al., "Minimizing the genome of *Escherichia coli*," *Ann NY Acad Science*, 745:1-3, 1994.

Koonin, "How many genes can make a cell: the minimal-gene-set concept," *Ann Rev Genome Hum Genet*, 1:99-116, 2000.

Lee, "High cell-density culture of *Escherichia coli*," *TIBTECH*, 14:98-103, 1996.

Mersereau et al., "Efficient transformation of *Agrobacterium tumefaciens* by electroporation," *Gene*, 90:149-151, 1990.

Murphy, "Use of bacteriophage λ recombination functions to promote gene replacement in *Escherichia coli*," *J. Bacteriol.*, 180:2063-2071, 1998.

Muyrers et al., "Rapid modification of bacterial artificial chromosomes by ET-recombination," *Nucleic Acids Research*, 27:1555-1557, 1999.

Neidhardt et al., "Culture medium for Enterobacteria," *J. Bacteriol.*, 119:736-747, 1974.

Office Communication issued in European patent application No. 07760207.6, dated Jul. 31, 2009.

Office Communication issued in U.S. Appl. No. 11/400,711, dated Mar. 6, 2009.

Office Communication issued in U.S. Appl. No. 11/400,711, dated Dec. 1, 2010.

Office Communication issued in U.S. Appl. No. 11/400,711, dated Jul. 22, 2009.

Office Communication issued in U.S. Appl. No. 11/400,711, dated Apr. 8, 2011.

Office Communication issued in U.S. Appl. No. 11/400,711, dated Aug. 9, 2011.

Oliner et al., "In vivo cloning of PCR products in *E. coli*," *Nucleic Acids Research*, 2(22):5192-5197, 1993.

Otto and Silhavy, "Surface sensing and adhesion of *E. coli* controlled by the Cpx-signaling pathway," *Proc. Natl. Acad. Sci., USA*, 99(4):2287-2292, 2002.

Park et al., "MppA, a periplasmic binding protein essential for import of the bacterial cell wall peptide L-Ananyl-γ-D-glutamyl-meso-diaminopimelate," *Journal of Bacteriology*, 180(5):1215-1223, 1998.

Passoth et al., "Analysis of the hypoxia-induced ADH2 promoter of the respiratory yeast *Pichia stipitis* reveals a new mechanism for sensing of oxygen limitation in yeast," *Yeast*, 20:39-51, 2003.

PCT/US2007/066087 International Search Report, mailed Sep. 17, 2007.

(56) References Cited

OTHER PUBLICATIONS

Perna et al., "Genome sequence of enterohemorrhagic *Escherichia coli* O157:H7," *Nature*, 409:529-533, 2001.
Perna et al., "The genomes of *Escherichia coli* K-12 and pathogenic *E. coli*," *Pathogenic E. coli Paradigm for Bacterial Pathogenesis*, M.S. Donnenberg, Editor, Academmic Press, 2002.
Pfeifer et al., "Biosynthesis of complex polyketides in metabolically engineered strain of *E. coli*," *Science* 291:1790-1792, 2001.
Ponce, "Effect of growth rate reduction and genetic modifications of acetate accumulation and biomass yields in *Escherichia coli*," *Biotechnology and Bioengineering*, 87:775-780, 1999.
Pope and Kent, "High efficiency 5 min transformation of *Escherichia coli*," *Nucleic Acids Research*, 24:536-537, 1996.
Posfai et al., "Emergent properties of reduced-genome *Escherichia coli*," *Science*, 312:1044-1046, 2002.
Posfai et al., "In vivo excision and amplification of large segments of the *Escherichia coli* genome," *Nucleic Acids Research*, 22(12):2392-2398, 1994.
Posfai et al., "Markerless gene replacement in *Escherichia coli* stimulated by a double-strand break in the chromosome," *Nucleic Acids Research*, 27:4409-4415, 1999.
Posfai et al., "Versatile insertion plasmids for targeted genome manipulations in bacteria: isolation, deletion, and rescue of the pathogenicity island LEE of the *Escherichia coli* O157:H7 genome," *J. Bacteriol.*, 179:4426-4428, 1997.
Pugsley, "The complete general secretory pathway in gram-negative bacteria," *Microbiol. Rev.*, 57:50-108, 1993.
Riesenberg, "High cell density cultivation of *E. coli* at controlled specific growth rate," *J. Biotech*, 20(10):17-27, 1991.
Riggs, "Expression and Purification of Maltose-Binding Protein Fusions," *Current Protocols Mol. Biol.*, 16.6.1-16.6.14, John Wiley and Sons, 1994.
Ritz and Beckwith, "Roles of thiol redox pathways in bacteria," *Annu Rev Microbiol*, 55:21-48, 2001.
Santini et al., "A novel sec-independent periplasmic protein translocation pathway in *Escherichia coli*," *EMBO J.*, 17:101-112, 1998.
Sargent et al., "Overlapping functions of components of a bacterial sec-independent protein export pathway," *EMBO J*, 17:3640-3650, 1998.
Schaechter and Neidhardt, "Introduction," In: *Escherichia coli and Salmonella*, ed. Neidhart, FC et al., 1-2, ASM Press, Washington, D.C., 1997.
Schutz et al., "Sulfide-quinone reductase from Rhodobacter capsulatus: requirement for growth, periplasmic localization, and extension of gene sequence analysis," *Journal of Bacteriology*, 181(20):6516-6523, 1999.
Selinger et al., "RNA expression analysis using a 30 base pair resolution *Escherichia coli* genome array," *Nat Biotechnol*, 18(12):1262-1268, 2000.
Sharma et al., "Recombinant protein production in an *Escherichia coli* reduced genome strain," *Metabolic Engineering*, 9:133-141, 2007.
Shiloach and Fass, "Growing *E. coli* to high cell density—A historical perspective on method development," *Biotechnology Advances*, 23:345-357, 2005.
Shiloach et al. "Effect of glucose supply strategy on acetate accumulation, by *Escherichia coli* BL21 (lambda-DE3)and *Escherichia coli* JM109," *Biotechnology and Bioengineering*, 49:421428, 1996.
Shuman, "Active transport of maltose in *Escherichia coli* K12," *J. Biol. Chem.*, 257(10):5455-5461, 1982.
Simmons and Yansura, "Translational level is a critical factor for secretion of heterologous proteins in *E. coli*," *Nature*, 14:629-634, 1996.
Singh-Gasson et al., "Maskless fabrication of light-directed oligonucleotide microarrays using a digital micromirror array," *Nat Biotechnol.*, 17(10):974-978, 1999.
Smalley et al., "In search of the minimal *Escherichia coli* genome," *Trends in Microbiology*, 11(1):6-8, 2003.
Swartz, "Advances in *E. coli* production of therapeutic proteins," *Curr. Opin in Biotech*, 12:195-201, 2001.
Thomas et al., "Export of active green fluorescent protein to the periplasm by the twin-arginine translocase (TAT) pathway in *Escherichia coli*," *Mol Micro*, 39(1):47-53, 2001.
Van Spanning et al., "Isolation and characterization of the moxJ, moxG, moxI, and moxR genes of *Paracoccus denitrificans*: Inactivation of moxJ, moxG, and moxR and the resultant effect on methylotrophic growth," *Journal of Bacteriology*, 173(21):6948-6961, 1991.
Vellai et al., "Genome economization and a new approach to the species concept in bacteria," *Proc R Soc Lond B*, 266:1953-1958, 1999.
Venkatesan et al., "Complete DNA sequence and analysis of the large virulence plasmid of Shigella flexneir.," *Infection of Immunity*, 3271-3285, 2001.
Waller and Sauer, "Characterization of degQ and degS, *Escherichia coli* genes encoding homologs of the DegP protease," *Journal of Bacteriology*, 178(4):1146-1153, 1996.
Weiner et al., "A novel and ubiquitous system for membrane targeting and secretion of cofactor-containing proteins," *Cell*, 93:93-101, 1998.
Welch et al., "Extensive mosaic structure revealed by the complete genome sequence of uropathogenic *Escherichia coli*," *Proc. Natl. Acad. Sci., USA*, 99(26):17020-17024, 2002.
Wirth et al., "Transformation of various species of gram-negative bacteria belonging to 11 different genera by electroporation," *Mol. Gen. Genet.*, 216:175-177, 1989.
Xu and Tabita, "Positive and negative regulation of sequences upstream of the form II cbb CO2 fixation operon of *Rhodobacter sphaeroides*," *J. Bacteriol.*, 176:7299-7308, 1994.
Yang et al., "Metabolic flux analysis of *Escherichia coli* deficient in the acetate production pathway and expressing the bacillus subtilis acetolactate synthase," *Metabolic Engineering* 1:26-34, 1999.
Yu et al., "An efficient recombination system for chromosome engineering in *Escherichia coli*," *Proc. Natl. Acad. Sci., USA*, 97:5978-5983, 2000.
Yu et al., "Minimization of the *Escherichia coli* genome using a Tn5-targeted Cre/LoxP excision system," *Nature Biotech*, 20:1018-1023, 2002.f.
Zhang et al., "A new logic for DNA engineering using recombination in *Escherichia coli*," *Nature Genetics*, 20:123-128, 1998.
Zhang et al., "DNA cloning by homologous recombination in *Escherichia coli*," *Nature Biotech.*, 18:1314-1317, 2000.
Zhang et al., "Phage annealing proteins promote oligonucleotide-directed mutagenesis in *Escherichia coli* and mouse ES cells," *BMC Molecular Biology*, 4:1, 2003.

Growth of MG1655 and MDS62 following the addition of bicyclomycin

PROPHAGE ELEMENT-FREE BACTERIA

CROSS-REFERENCE TO RELATED APPLICATIONS

This application is a continuation-in-part of U.S. application Ser. No. 11/400,711, filed Apr. 7, 2006, which is a continuation-in-part of U.S. application Ser. No. 11/275,094, filed Dec. 9, 2005, which claims the benefit of U.S. Provisional Application No. 60/634,611, filed Dec. 9, 2004 and which is a continuation-in-part of U.S. application Ser. No. 10/896,739, filed Jul. 22, 2004 (abandoned), which is a continuation of International Application No. PCT/US03/01800, filed Jan. 22, 2003, which claims the benefit of U.S. Provisional Application No. 60/409,089, filed Sep. 6, 2002 and which is a continuation-in-part of U.S. application Ser. No. 10/057,582, filed Jan. 23, 2002 (now U.S. Pat. No. 6,989,265), each of which is incorporated herein by reference.

STATEMENT REGARDING FEDERALLY SPONSORED RESEARCH OR DEVELOPMENT

This invention was made with government support under GM35682 awarded by the National Institutes of Health. The government has certain rights in the invention.

BACKGROUND OF THE INVENTION

Bacteria have been used to produce a wide range of commercial products. For example, many *Streptomyces* strains and *Bacillus* strains have been used to produce antibiotics; *Pseudomonas denitrificans* and many *Propionibacterium* strains have been used to produce vitamin B12; some other bacteria have been used to produce vitamin Riboflavin; *Brevibacterium flavum* and *Corynebacterium glutamicum* have been used to produce lysine and glutamic acid, respectively, as food additives; other bacteria have been used to produce other amino acids used as food additives; *Alcaligenes eutrophas* has been used to produce biodegradable microbial plastics; and many *Acetobacter* and *Gluconobacter* strains have been used to produce vinegar. More recently, it has become common for bacteria, such as *Escherichia coli* (*E. coli*), to be genetically engineered and used as host cells for the production of biological reagents, such as proteins and nucleic acids, in laboratory as well as industrial settings. The pharmaceutical industry supports several examples of successful products which are human proteins which are manufactured in *E. coli* cultures cultivated in a fermenter.

It is not an uncommon occurrence for normal bacterial proteins to adversely affect the production or the purification of a desired protein product from an engineered bacteria. For example, when *E. coli* bacteria are used as host cells to generate a large quantity of a desired product encoded by a gene that is introduced into the host cells by a plasmid, certain normal *E. coli* gene products can interfere with the introduction and maintenance of plasmid DNA. More significantly, because of the economies of bacterial culture in making proteins in bacteria, often the cost of purification of a recombinant protein can be more than the cost of production, and some of the natural proteins produced by the bacterial host are sensitive purification problems. Further, many bacterial strains produce toxins that must be purified away from the target protein being produced and some strains can produce, by coincidence, native proteins that are close in size to the target protein, thereby making size separation not available for the purification process.

Also, however, the genome of a bacteria used in a fermenter to produce a recombinant protein includes many unnecessary genes. A bacteria living in a natural environment has many condition responsive genes to provide mechanisms for surviving difficult environmental conditions of temperature, stress or lack of food source. Bacteria living in a fermentation tank do not have these problems and hence do not require these condition responsive genes. The bacterial host spends metabolic energy each multiplication cycle replicating these genes. Thus the unnecessary genes and the unneeded proteins, produced by a bacterial host used for production of recombinant protein, result is a lack of efficiencies in the system that could be improved upon.

It is not terribly difficult to make deletions in the genome of a microorganism. One can perform random deletion studies in organisms by simply deleting genomic regions to study what traits of the organism are lost by the deleted genes. It is more difficult, however, to make targeted deletions of specific regions of genomic DNA and more difficult still if one of the objectives of the method is to leave no inserted DNA, here termed a "scar," behind in the organism after the deletion. If regions of inserted DNA, i.e. scars, are left behind after a genomic deletion procedure, those regions can be the locations for unwanted recombination events that could excise from the genome regions that are desirable or engender genome rearrangements. In building a series of multiple deletions, scars left behind in previous steps could become artifactual targets for succeeding steps of deletion. This is especially so when the method is used repeatedly to generate a series of deletions from the genome. In other words, the organism becomes by the deletion process genetically unstable if inserted DNA is left behind.

BRIEF SUMMARY OF THE INVENTION

The present invention provides methods for reducing the genome of an organism particularly without leaving scars in the genome.

In one embodiment, the present invention provides a bacterium having a genome that is genetically engineered to be at least two percent (2%) to twenty percent (20%) smaller than the genome of its native parent strain. Particularly, the genome is at least seven percent (7%) smaller than the genome of the native parent. More particularly, the genome is eight percent (8%) to fourteen percent (14%) to twenty percent (20%) smaller than the genome of its native parent strain. When used to produce a product, a bacterium with a smaller genome can have one or more of the following advantages. One, the production process can be more efficient either in terms of resource consumption or in terms of production speed, ultimate yield percent or all three. Two, the product purification process can be simplified or purer products can be made. Three, a product that cannot be produced before due to native protein interference can be produced. Four, the yield per cell of the desired product may be increased.

The present invention is also directed to an organism, particularly a bacterium, engineered to have a "clean genome," i.e., lacking, for example, genetic material such as certain genes unnecessary for growth and metabolism of the bacteria, insertion sequences (transposable element), pseudogenes, prophage, endogenous restriction-modification genes, pathogenicity genes, toxin genes, fimbrial genes, periplasmic protein genes, invasin genes, sequences of unknown function and sequences not found in common between two strains of the same native parental species of bacterium. Other DNA sequences that are not required for cell survival and production of certain proteins in culture can be deleted. The reduced genome bacteria of the present invention may be viewed as a basic genetic framework to which may be added a myriad of genetic elements for expression of useful products as well as genetic control elements which offers an unprecedented opportunity to fine tune or optimize the expression of the desired product.

The present invention also provides materials and methods for targeted deletion of genes and other DNA sequences from a bacterial genome without leaving any residual DNA from the manipulation (scarless deletion). Since the methods of the present invention seldom introduce mutations or leave residual DNA in the genomic DNA sequences around deletion sites, the methods can be used to generate a series of deletions in a bacterium without increasing the possibility of undesired homologous recombination within the genome. Some of these methods are also useful for making similar deletions, for example, in bacteriophage, native plasmids and the like, as well as in higher organisms, such as mammals and plants.

The first deletion method is linear DNA-based. To perform the process, first, a linear DNA construct is provided in a bacterium and a region of the bacterial genome is replaced by the linear DNA construct through homologous recombination aided by a system residing in the bacterium that can increase the frequency of homologous recombination. Next, a separate gene previously introduced into the bacterium expresses a sequence-specific nuclease to cut the bacterial genome at a unique recognition site located on the linear DNA construct. Then, a DNA sequence engineered to contain DNA homologous to a target in the genomic DNA at one end of the linear DNA construct undergoes homologous recombination with a similar genomic DNA sequence located close to the other end of the linear DNA construct. The net result is a precise deletion of a region of the genome.

The second method is also linear DNA-based. Two DNA sequences, one of which is identical to a sequence that flanks one end of a bacterial genome region to be deleted and the other of which is identical to a sequence that flanks the other end of the bacterial genome region to be deleted, are engineered into a vector in which the two sequences are located next to each other. At least one sequence-specific nuclease recognition site is also engineered into the vector on one side of the two sequences. The vector is introduced into a bacterium and a linear DNA is generated inside the bacterium by expressing inside the bacterium a nuclease that recognizes the sequence-specific nuclease recognition site and cuts the vector therein. The linear DNA undergoes homologous recombination with the bacterial genome aided by a system residing in the bacterium to increase the frequency of homologous recombination. A bacterium with a targeted deletion free of residual artifactual in its genome is thus produced.

The second method described above can also be used to replace a selected region of a bacterial genome with a desired DNA sequence. In this case, a desired DNA sequence that can undergo homologous recombination with and hence replace the selected region is engineered into the vector. All other aspects are the same as for deleting a targeted region.

The third method is suicide plasmid-based. The specific plasmid used in this method contains an origin of replication controlled by a promoter and a selectable marker, such as an antibiotic resistance gene. To delete a targeted region of a bacterial genome, a DNA insert that contains two DNA sequences located right next to each other, one of which is identical to a sequence that flanks one end of a bacterial genome region to be deleted and the other of which is identical to a sequence that flanks the other end of the bacterial genome region, is inserted into the plasmid. The plasmid is then introduced into the bacteria and integrated into the bacterial genome. Next, the promoter is activated to induce replication from the ectopic origin introduced into the bacterial genome so that recombination events are selected. In many bacteria, the recombination events will result in a precise deletion of the targeted region of the bacterial genome and these bacteria can be identified. An alternative way to select for recombination events is to engineer a recognition site of a sequence-specific nuclease into the specific plasmid and cut the bacterial genome with the sequence-specific nuclease after the plasmid has integrated into the bacterial genome.

The suicide plasmid-based method described above can also be used to replace a selected region of a bacterial genome with a desired DNA sequence. In this case, a DNA insert that contains a desired DNA sequence that can undergo homologous recombination with and hence replace the selected region is inserted into the plasmid. All other aspects are the same as for deleting a targeted region.

The methods of the present invention are useful inter alia for engineering reduced genome bacteria for the production of recombinant gene products. Such engineered bacteria allow improved production of such proteins by increasing the efficiency of production and yield of the desired gene product as well as allowing more efficient purification of the product by virtue of the elimination of unnecessary bacterial gene products. A particular reduced genome bacteria of the present invention is a bacteria from which one or more native genes encoding periplasmic proteins and/or membrane proteins have been deleted.

The present invention is also directed to DNAs and vectors used for carrying out the methods of the present invention, methods for preparing the DNAs and to kits containing vials which vials contain one or more DNAs or vectors of the present invention and optionally suitable buffers, primers, endonucleases, nucleotides, and polymerases.

The present invention is also directed to live vaccines comprising a reduced genome bacterium of the present invention or comprising a reduced genome bacterium of the present invention into which is introduced DNA encoding antigenic determinants of pathogenic organisms operably associated with expression control sequences which allow the expression of said antigenic determinants. Also within the scope of the present invention is a live vaccine comprising a reduced genome bacterium of the present invention in to which has been introduced a DNA, derived from a pathogenic organism and optionally having an origin of replication, said live vaccine being capable of inducing an enhanced immune response in a hose against a pathogenic organism. The DNA may be methylated at a methylation site. The invention is also directed to a live vaccine produced from a pathogenic organism by deleting from the genome of that organism the genes responsible for pathogenicity while retaining other antigenic determinants.

Other objects, features and advantages of the invention will become apparent upon consideration of the following detailed description.

DETAILED DESCRIPTION OF THE INVENTION

Figure 1:
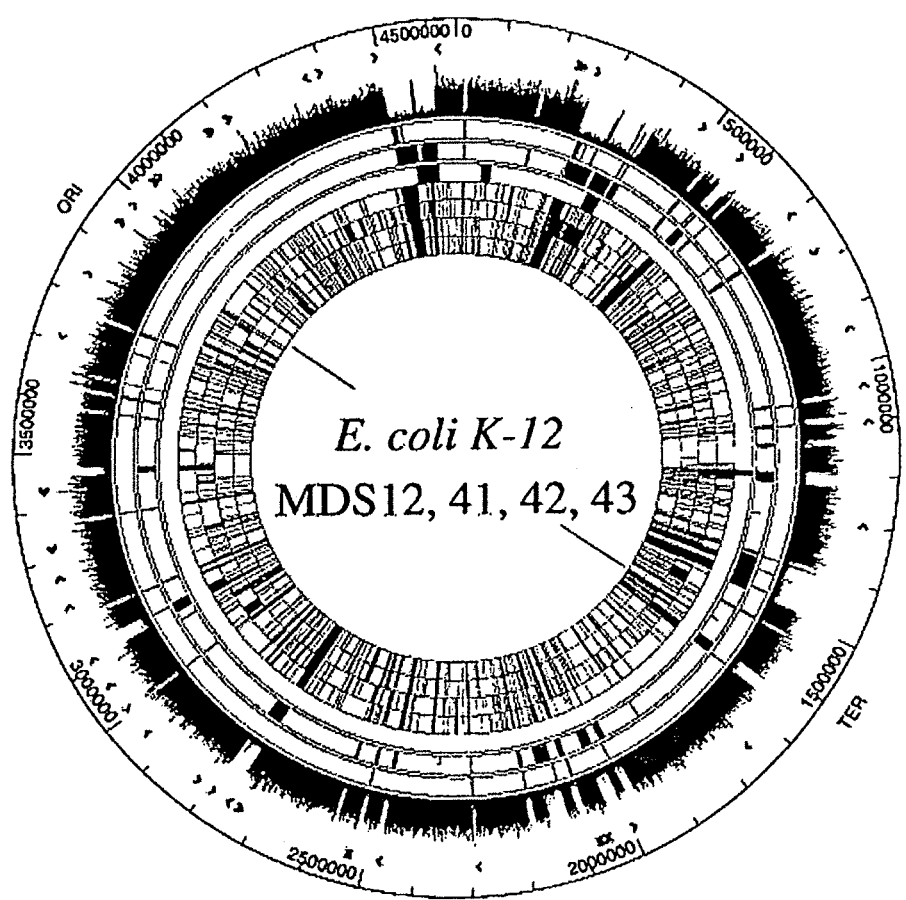
FIG. 1 shows positions of the genes and other DNA sequences on *E. coli* K-12 bacterial genome that were candidates for deletion as black and lighter hatched boxes on the outermost ring.

Bacteria in their natural environment are exposed to many conditions that are not normally experienced in standard industrial or laboratory growth, and thus carry a large number of condition-dependent, stress-induced genes or otherwise nonessential genes which may not be needed in industrial or laboratory use of the organisms. This invention began with the realization that much of the genetic information contained within the genome of a bacteria strain could be deleted without detrimental effect to use of bacteria cultures in processes of industrial or laboratory importance. It was recognized that a bacterium with a reduced genome might be advantageous over native strains in many industrial and laboratory applications. For example, a bacterium with a reduced genome is at least somewhat less metabolically demanding and thus can produce a desired product more efficiently. In addition, a reduced genome can lead to fewer native products and lower level of certain native proteins, allowing easier purification of a desired protein from the remaining bacterial proteins. Furthermore, some bacterial genetic sequences are associated with instabilities that can interfere with standard industrial or laboratory practices, and might entail costly and burdensome quality control procedures.

The present invention also involves several methods for deleting genomic DNA from a genome without leaving any inserted DNA behind (scarless deletion). If one is making several sequential deletions from the single DNA molecule which makes up a bacterial genome, it is important not to leave any inserted DNA sequences behind. Such inserted sequences, if they were left behind, would be candidate sites for undesired recombination events that would delete uncharacterized and perhaps important portions of the remaining genome from the bacteria or cause other unanticipated genome rearrangements with untoward effects. Since one of the objectives of the genome reduction effort is to increase the genetic stability of the bacteria, leaving any inserted DNA behind would be contrary to the objective, and should be avoided. Thus the methods used to delete DNA from the genome become important and sophisticated.

In one aspect, the present invention relates to a bacterium having a genome that is genetically engineered to be smaller than the genome of its native parent strain. For exemplary purposes, the work described here has focused on the common laboratory and industrial bacterium Escherichia coli. The genome reduction work described here began with the laboratory E. coli strain K-12, which had prior to the work described here, a genome of 4,639,221 nucleotides or base pairs. The bacterium of the present invention can have a genome that is at least two percent (2%), in particular over five percent (5%), more particularly over seven percent (7%) to eight percent (8%) to fourteen percent (14%) to eighteen percent (18%) to twenty percent (20%), to forty percent (40%) to sixty percent (60%) smaller than the genome of its native parental strain. In particular, the genome is at least five percent (5%) and up to eight percent (8%), up to fourteen percent (14%), up to twenty percent (20%) or up to thirty percent (30%) smaller than the genome of a native parent strain. The reduced genome bacterium may also have a genome that is between 4.41 Mb and 3.71 Mb, between 4.41 Mb and 3.25 Mb or between 4.41 Mb and 2.78 Mb. The term "native parental strain" means a bacteria strain (or other organism) found in natural or native environment as commonly understood by the scientific community and on whose genome a series of deletions can be made to generate a bacterial strain with a smaller genome. The percentage by which a genome has become smaller after a series of deletions is calculated by dividing "the total number of base pairs deleted after all of the deletions" by "the total number of base pairs in the genome before all of the deletions" and then multiplying by 100.

Another aspect of the present invention comprises a reduced genome bacteria in which about 5% to about 10% of its protein coding genes are detailed. In particular, about 10% to 20% of the protein coding genes are deleted. In another embodiment of the invention, about 30% to about 40%) to about 60% of the protein encoding genes are deleted.

Generally speaking, the types of genes, and other DNA sequences, that can be deleted are those the deletion of which does not adversely affect the rate of survival and proliferation of the bacteria under specific growth conditions. Whether a level of adverse effect is acceptable depends on a specific application. For example, a 30% reduction in proliferation rate may be acceptable for one application but not another. In addition, adverse effect of deleting a DNA sequence from the genome may be reduced by measures such as changing culture conditions. Such measures may turn an unacceptable adverse effect to an acceptable one. In particular, the proliferation rate is approximately the same as the parental strain. However, proliferation rates ranging from about 5%, 10%, 15%, 20%, 30%, 40% to about 50% lower than that of the parental strain are within the scope of the invention. More particularly, particular doubling times of bacteria of the present invention may range from about thirty minutes to about three hours.

The bacteria of the present invention maybe engineered by the methods of the present invention to optimize their use of available resources (i.e., nutrients) for the production of desired products. Those products may be recombinant proteins, by way on non-limiting example insulin, interleukins, cytokines, growth hormones, growth factors, erythropoietin, colony stimulating factors, interferon, antibodies, antibody fragments, or any other useful recombinant protein. The recombinant product may be a therapeutic product, a vaccine component, a diagnostic product, or a research reagent. The bacteria may also be used as a background to express industrially useful products such as commercially useful metabolic intermediates and end products such as vanillin, shikimic acid, amino acids, vitamins, organic acids, and the like, and chemical compounds not naturally produced in the bacteria but produced as a result of metabolic pathway engineering or other genetic manipulation—(see, e.g., U.S. Pat. Nos. 6,472, 169 and 6,372,476, both of which are incorporated herein by reference).

Below, E. coli is used as an example to illustrate the genes and other DNA sequences that are candidates for deletion in order to generate a bacterium that can produce a desired product more efficiently. The general principles illustrated and the types of genes and other DNA sequences identified as candidates for deletion are applicable to other bacteria species or strains. It is understood that genes and other DNA sequences identified below as deletion candidates are only examples. Many other E. coli genes and other DNA sequences not identified may also be deleted without affecting cell survival and proliferation to an unacceptable level.

The native parent strain of the reduced genome bacterium may be any bacterial strain, as well as an intermediate strain from which the bacterium is derived. Representative examples of parent strains include, but are not limited to, E. coli strains such as K-12 or B, or a strain with a genome sequence substantially identical thereto. The E. coli K-12 strain may be a derivative strain including, but not limited to MG1655, DH10B, DH5α, Invα, Top10, Top10F, JM103, JM105, JM109, MC1061, MC4100, XL1-Blue, EC100 or EC300. E. coli B strains include REL606, BL/R and BL21 (DE3).

The nucleotide sequence of the genome of the parental strain may be partially or completely known. In particular, the entire sequence is available. Such complete or partial sequences are readily available in the Gen\\ database. The full genomic sequence of several strains of E. coli is, of course, now published (for example, Blattner et al., 1997, K-12 Strain MG1655; See also GenBank Accession No. U00096; Perna et al, 2001; Hayashi et al., 2001; and Welch et al., 2002, GenBank Accession No. AE014075, and GenBank Accession No. CP001509, all of which are incorporated herein by reference in their entirety), as is the sequence of several other commonly used laboratory bacteria. The nucleic acid sequence of E. coli MG1655 (annotated version m56), (NCBI accession no. U00096.1) is set forth in SEQ ID NO: 1 with a total size of 4,639,675 nucleotides or base pairs. To start the deletion process, the genome of the bacteria is analyzed to look for those sequences that represent good candidates for deletion. Of course, these techniques can also be applied to partially sequenced genomes in the genomic areas for which sequence date is available or could be determined.

In E. coli, and other bacteria as well, as well as in higher organisms, a type of DNA sequence that can be deleted includes those that in general will adversely affect the stability of the organism or of the gene products of that organism. Such elements that give rise to instability include transposable elements, insertion sequences, and other "selfish DNA" elements which may play a role in genome instability. For example, insertion sequence (IS) elements and their associated transposes are often found in bacterial genomes, and thus are targets for deletion. IS sequences are common in E. coli, and all of them may be deleted. For purposes of clarity in this document, the inventors use the term IS element and transposable element generically to refer to DNA elements, whether intact or defective, that can move from one point to another in the genome. An example of the detrimental effects of IS elements in science and technology is the fact that they can hop from the genome of the host E. coli into a BAC plasmid during propagation for sequencing. Many instance are found in the human genome and other sequences in the GenBank database. This artifact could be prevented by deletion from the host cells of all IS elements. For a specific application, other specific genes associated with genomic instability may also be deleted.

The deletion of all IS sequences from host cells (for example, E. coli) according to the present invention which, results in a "clean genome" as described above, provides a more genetically stable and useful cell. Additional DNA may be deleted from such a "clean genome" cell. The additional DNA to be deleted may be determined by the particular use for which the strain is intended. Such DNA may include, for example, DNA not required for cell survival and or growth.

Shown in FIG. 1 is illustration of the E. coli genome, which natively, in the K-12 strain, comprises 4,639,221 base pairs. FIG. 1, shows, on the inner ring, the scale of the base pair positions of the E. coli K-12 genome (strain MG1655), scaled without deletions (see also Blattner et al., supra). The next ring progressively outward shows regions of the K-12 genome that are missing or highly altered in a related strain O157:H7, and which are thus potentially detectable from the K-12 genome. The next ring outward shows the positions of the IS elements, both complete and partial, in the native genome. The next ring moving outward shows the positions of the RHS elements A to E and flagellar and restriction regions specially targeted for deletion here. The outermost ring shows the location of the deletions actually made to the genome, as also listed in Tables 1 and 2 below. These deletions make up about 14 percent of the base pairs in the original K-12 MG1655 genome. Using methods of the present invention 18% to 20% to about 40% of the genome will be deleted using the design paradigms described herein.

Another family of E. coli genes that can be deleted are the restriction modification system genes and other endogenous nucleases whose products destroy foreign DNA. These genes are not important for bacterial survival and growth in culture environments. These genes can also interfere with genetic engineering by destroying plasmids introduced into a bacterium. Positions of restriction modification system genes on an E. coli genome map are shown in FIG. 1 and Table 1. In one embodiment of the invention, other DNA methylase genes may be added back to the deleted E. coli strain so as to optimize the strain for certain uses, for example, eukaryotic methylase genes.

Another family of E. coli genes that can be deleted is the flagella gene family. Flagella are responsible for motility in bacteria. In natural environments, bacteria swim to search for nutrients. In cultured environments, bacteria motility is not important for cell survival and growth and the swimming action is metabolically very expensive, consuming over 1% of the cellular energy to no benefit. Thus, the flagella genes may be deleted in generating a bacterium with a smaller genome. Positions of flagella genes on an E. coli genome map are shown in FIG. 1 and Table 1.

One type of E. coli DNA element, already mentioned, that can be deleted is the IS elements (or transposable elements). IS elements are not important for bacteria survival and growth in a cultured environment and are known to interfere with genome stability. Thus, the IS elements can be deleted in generating a bacterium with a smaller genome. Positions of the IS elements on an E. coli genome map are shown in FIG. 1 and Table 1.

Another type of E. coli DNA element that can be deleted is the Rhs elements. All Rhs elements share a 3.7 Kb Rhs core, which is a large homologous repeated region (there are 5 copies in E. coli K-12) that provides a means for genome rearrangement via homologous recombination. The Rhs elements are accessory elements which largely evolved in some other background and spread to E. coli by horizontal exchange after divergence of *E. coli* as a species. Positions of the Rhs elements on an *E. coli* genome map are shown in FIG. 1 and Table 1.

One type of region in the *E. coli* genome that can be deleted is the non-transcribed regions because they are less likely to be important for cell survival and proliferation. Another type of regions in the *E. coli* genome that can be deleted is the hsd regions. The hsd regions encode for the major restriction modification gene family which has been discussed above. Positions of the non-transcribed regions and the hsd regions on an *E. coli* genome map are shown in FIG. 1 and Table 1.

Prophages, pseudogenes, toxin genes, pathogenicity genes, periplasmic protein genes, membrane protein genes are also among the genes that may be deleted, based on the gene selection paradigm discussed herein. After the sequence of *E. coli* K-12 (see Blattner, et al., supra), was compared to the sequence of its close relative O157:H7 (See Perna et al., supra) and it was discussed that 22% (K-12) and 46% (O157:H7) of the protein encoding genes were located on strain specific islands of from one to about 85 kb inserted randomly into a relatively constant backbone.

Prophages consist of viral DNA incorporated into the host bacterial genome. Over time, due to genome rearrangements and the like, the inserted viral DNA may become inactive, or cryptic, and lose the ability to produce active phage. Nevertheless, these cryptic prophages may retain the capacity for producing gene products that are deleterious to the host bacteria, particularly during periods of stress, during which cryptic prophage can reactivate. Prophage elements of special concern are genes encoding lysin and holin proteins that can compromise cellular integrity and viability if expressed. *E. coli* production strains typically contain approximately a dozen prophages. Positions of prophage elements on an *E. coli* genome map are shown at Table 1.

*E. coli* K12 strains cumulatively contain twelve prophages which comprise ~3.6% of the genome: CP4-6, DLP12, e14, phi80Lac, rac, Qin, CP4-44, P2*B/PR-X, CPS-53/KpLE1, CPZ-55, CP4-57/SsrA*B, and KpLE2. Each of these prophages may be partially or entirely deleted. Reduced genome strain MDS12 has all of the prophage elements of parent strain MG1655 deleted therefrom and all subsequently created strains (MDS13, MDS14, MDS15 . . . MDS40) also lack all prophage elements. Strain MDS40 (and all subsequently created strains) additionally lack all insertion sequences. The genetic position of each K12 prophage, as well as the first reduced genome strain from which each prophage was deleted, is listed below.

| Prophage | Genes | Location | Reduced Genome Strain |
|---|---|---|---|
| CP4-6 | b0245-b0281 | 262182-296489 | MD1 |
| DLP12 | b0537-b0565 | 564025-585326 | MD12 |
| e14 | b1137-b1159 | 1195443-1210646 | MD11 |
| rac | b1345-b1375 | 1409966-1433025 | MD2 |
| Qin | b1544-b1579 | 1630450-1646830 | MD8 |
| CP4-44 | b1994-b2006 | 2064181-2077053 | MD5 |
| PR-X | b2082-b2084 | 2165324-2166023 | MD37 |
| CPS-53 | b2349-b2363 | 2464404-2474619 | MD7 |
| CPZ-55 | b2442-b2450 | 2556791-2563352 | MD3 |
| CP4-57 | b2662-b2646 | 2753978-2776007 | MD4 |
| KpLE2 | b4271-b4308 | 4494108-4534178 | MD9 |

*E. coli* B strains contain all or a subset of eleven prophages: DLP12, X*B, RybB*B, Rac, Qin, CP4-44, P2*B/PR-X, CP4-57/SsrA*B, PheV*B, SelC*B and KpLE2. Each of these prophages may be partially or entirely deleted. Thus in one aspect, the present invention provides a reduced genome *E. coli* bacterium lacking all or a subset of prophage elements from these prophages. The genetic position of each BL21 (DE3) prophage is listed below.

| Prophage | Genes | Location | Reduced Genome Strain |
|---|---|---|---|
| DLP12 | ECD00486-ECD00513 | 533895-550997 | BL1 |
| Lambda DE3 | ECD10001-ECD10058 | 748396-791335 | |
| Rybb*B | ECD00815-ECD00851 | 872499-892617 | |
| rac | ECD01322-ECD01346 | 1397093-1410543 | |
| Qin | ECD01503-ECD05147 | 1581583-1597951 | |
| CP4-44 | ECD01903-ECD01909 | 1971307-1975275 | BL2 |
| SsrA*B/CP4-57 | ECD02509-ECD02152 | 2622524-2627371 | |
| Phev*B | ECD02797-ECD02811 | 2941466-2944376 | BL5 |
| Selc*B | ECD03516-ECD03540 | 3703770-3724679 | |
| KpLE2 | ECD04136-ECD04181 | 4408133-4445112 | |

A list of the prophages of several *E. coli* K12 and B strains is provided below:

| | *E. coli* B strains | | *E. coli* K12 strains | | | | |
|---|---|---|---|---|---|---|---|
| Prophage | REL606 | BL21(DE3) | DH10B | DH5a | Stabl3 | W3110 | MG1655 |
| CP4-6 | | | X | X | X | X | X |
| DLP12 | X | X | X | X | X | X | X |
| λ*B | X | X | | | | | |
| RybB*B | X | X | | | | | |
| e14 | | | | X | X | X | X |
| phi80Lac | | | X | X | | | |
| Rac | X | X | X | X | | X | X |
| Qin | X | X | X | X | X | X | X |
| CP4-44 | X | X | X | X | X | X | X |
| P2*B | X | | X | X | X | X | X |
| CPS-53 | | | X | X | X | X | X |
| CPZ-55 | | | X | | | | X |
| SsrA*B | X | X | X | X | | X | X |
| PheV*B | X | X | | | | | |
| SelC*B | X | X | | | | | |
| KpLE2 | X | X | X | X | X | X | X |
| Total | 11 | 10 | 11 | 11 | 8 | 10 | 11 |

In one aspect, the present invention provides a reduced genome *E. coli* bacterium lacking all or a subset of elements from these prophages. In a particular embodiment, the reduced genome *E. coli* lacks all lysin and holin genes from each of these prophages.

Among other genes that may be deleted are genes that encode bacteriophage receptors including, for example, tonA (FhuA) and/or its complete operon fhu ABC which encodes the receptor for the lytic phage T1.

One general method to identify additional genes and DNA sequences as deletion candidates is to compare the genome of one bacterial strain to one or more others strains. Any DNA sequences that are not present in two or three of the strains are less likely to be functionally essential and thus can be used for identifying candidates for deletion. In the examples described below, the complete genomic sequences of two *E. coli* strains, O157:H7 EDL933 and K-12 MG1655, were compared. DNA sequences that were not found in both strains were used to identify targets for deletion. Twelve such identified targets from *E. coli* strain MG1655 were deleted, resulting in a bacteria strain with a genome that is about 8% smaller. The bacteria with the reduced genome grow at substantially the same rate as the native parent MG1655 strain.

The DNA sequence of a uropathogenic *E. coli* strain CFT073 H7 (see Welch et al., supra), was recently determined and its sequence was compared to the K-12 (MG1655) and O157:H7. Results show that only about 40% of all coding genes found in any one of the genomes is present in all of the genomes and CFT073, K-12 and O157:H7 are composed of 67%, 43% and 68% strain specific island genes. Based on this information, as much as about 60% of the protein coding sequences may be deleted from *E. coli*. In particular, at least 5% or about 90% or about 15% or about 21% of the protein coding genes are deleted. More particularly, about 30% of the protein coding genes are deleted. It should be noted that there may be genes essential for growth in one strain that are not required for growth in other strains. In such cases, the gene essential for growth of that strain is not deleted from the strain or if deleted is replaced with another gene with a complementary function so as to permit growth of the strain.

In a particular embodiment of the invention, sequence information is used to select additional genes from (using the methods of the present invention) an *E. coli* genome so as to produce a genome of about 3.7 megabases (about 20% smaller than K-12) containing 73 deletions to remove about 100 "islands" and surrounding DNAs that will still allow for adequate growth of the strain when cultured on minimal media. The design also calls for complete elimination of any remaining transposable elements (IS sequences) from the genome.

Perisplasmic Cleansing and Protein Expression

For reasons discussed herein, there remains a need in the art for production of recombinant proteins which will be secreted into the periplasmic space of bacteria and the methods of the present invention provide for the engineering of bacteria to optimize periplasmic expression.

Gram-negative bacteria, such as *E. coli*, have two cellular membranes, the inner cell membrane and the outer cell membrane. Two membranes are separated by a periplasmic space (PS). Bacterial proteins with appropriate signal sequences are secreted through the inner cell membrane into the PS by at least two different systems, Sec-system and Tat-system. (Danese et al., 1998; Fekes et al., 1999; and Pugsley, 1993 (sic); Hynds et al., 1998; Santini et al., 1998; Sargent et al., 1998 (TAT) all of which are incorporated herein by reference.

The Sec-system recognizes an appropriate signal peptide and transports the protein, using cytoplasmic ATP and electronmotive force, into the periplasm in an unfolded state. After cleavage of the signal protein, the new protein folds with the aid of chaperones, peptidyl-prolyl isomerases, and a thioredoxin linked system which catalyses disulfide bond formation. See, e.g., Hynds et al., 1998; Santini et al., 1998; Sargent et al., 1998 (TAT), all of which are incorporated herein by reference.

In contrast to Sec-system, the Tat-system transports large proteins in fully folded conformation and is more specific in recognition of appropriate signal sequences. The inventors have selected the periplasm because (1) it is a particular site for expressing heterologous recombinant proteins, (2) for industrial use in controlled conditions, it has many unnecessary proteins, and (3) it plays a role in many unnecessary adaptation and control systems, some of which appear to be detrimental. By removing native proteins from the periplasm, the inventors anticipate that they will be able to greatly improve the process for protein production. Expression and secretion of proteins in the periplasm has been reviewed in Hanahan, 1983; Hockney, 1994; and Hannig et al., 1998, all of which are incorporated by reference.

There are several reasons why the periplasm is a good site for protein production; (1) it is possible to produce a recombinant protein with the amino terminus identical to the natural protein, whereas in the cytoplasm, proteins invariably begin with the amino acid methionine; (2) many proteins can fold correctly in the periplasmic space (3) the correct disulfide bonds can form in the oxidising environment of the periplasm; (4) the periplasmic space contains much less and far fewer proteins than the cytoplasm, simplifying purification (5) there are fewer proteases than in the cytoplasm, reducing protein digestion and loss; (6) expressed proteins can be readily released with other periplasmic proteins by specifically disrupting the outer membrane, substantially free of the more abundant cytoplasmic proteins. The periplasmic space has natural enzyme systems, linked to cellular cytoplasmic metabolism through the inner membrane, to undertake these processing tasks, presumably because this is the organelle in which most inner and outer membrane proteins are processed. By contrast, it has proven very difficult to obtain proper folding of recombinant protein chains expressed in the reducing environment of the cytoplasm. Often proteins aggregate into insoluble "inclusion bodies." Whilst initial inclusion body purification might be simpler, the proteins need to be re-dissolved and re-folded, a process that is unpredictable and difficult to control, and for some proteins, so inefficient as to be unworkable at industrial scale.

Recombinant proteins are generally produced in the periplasm by expressing fusion proteins in which they are attached to a signal peptide that causes secretion into the periplasmic space. There the signal peptide is cleaved off very precisely by specific signal peptidases. Second generation recombinant human growth hormone is manufactured by this method by Genentech (Nutropin, Full Prescriber Information.) and Pharmacia. Not all proteins can be successfully produced by this route and there is evidence that the secretion and post-secretion processing systems have limited capacity. Also, there are still protein contaminants to deal with. Notably, there is a warning on one such approved product, that it contains traces of *E. coli* periplasmic proteins that cause the production of antibodies in some patients (Gonotropin: Full Prescriber information). While it is claimed that this is not a problem in the clinic, it must be regarded as undesirable. The materials and methods of the present invention will allow the reduction or elimination of this problem.

There is need in the art for production of recombinant proteins which will be secreted into PS. This secretion may be accomplished by utilizing Sec- or Tat-systems or any other secreting pathogens available in the respective bacteria. In either case, the appropriate signal peptide will be added to the recombinant protein. If the Sec-system is to be used, than the following additional experiments are needed. Since there are reports that Sec-system can be saturated by high efficiency expression constructs, the first set of experiments will be to develop a system with optimum expression level of the recombinant protein which can be properly transported and folded in PS.

Recombinant DNA constructs useful for periplasmic expression in the reduced genome bacteria of the present invention comprise a first DNA sequence coding for a signal peptide capable of mediating transport of a protein to the periplasmic space operatively linked to at least a second DNA sequence coding for a desired heterologous protein. The signal sequence maybe native to the protein to be expressed. In particular, the protein transported into the periplasmic space is biologically active. Expression of the recombinant DNA construct may be under the control of an inducible promoter or a promoter that is constitutively expressed in the host bacterium. The use of inducible promoters is particularly advantageous when using the Sec system which is known to be saturable. For example, lac-based promoter/repressor, inducible by the non-metabolisable galactose derivative, IPTG, may be used. Such promoters allow fine tuning of expression and secretion through the Sec system thereby optimizing periplasmic expression.

The recombinant protein may also be co-expressed with chaperones/disulfide-bond forming enzymes to ensure proper folding of the recombinant protein. DNA sequences useful for periplasmic expression of recombinant protein include but are not limited to those described in U.S. Pat. Nos. 5,747,662; 5,578,464; 6,335,178; and 6,022,952. Thomas et al., 2001; Weiner et al., 1998; and *Current Protocols in Molecular Biology*, 1994, all of which are incorporated herein by reference in their entirety.

In one embodiment of the present invention, nine known and 3 putative periplasmic protein genes were successfully deleted in constructing MDS40, without significantly affecting the ability of the organism to grow on minimal medium. (See Table 4 and data below). These mutations affect a range of functions, including amino acid uptake, inorganic metabolism, cell membrane maintenance, sugar metabolism, and adhesion.

Approximately 85 genes have been deleted that code for known or putative membrane proteins, identified by their signal-peptide sequences. Of these 33 are involved in flagellar structure or biosynthesis; 9 are involved in fimbrial structure or biosynthesis; and 13 are involved in general secretory pathways. The remainder have a variety of known or putative functions in the cell membranes. Many of these proteins are believed to be processed in the periplasmic space. They have also been deleted in constructing MDS40, without significantly affecting the ability of the organism to grow on minimal medium.

By searching for signal peptide-like sequences in annotated MG1655 databases, and cross-relating these with the literature the inventors have identified 181 proteins that the majority of which are believed to be resident periplasmic proteins. A number of these proteins have been classified according to function into several groups excluding: adhesion and mobility; nutrient and salt uptake, trace element uptake; environmental sensing; defense and protection; and periplasmic protein secretion and processing. Among the genes or full operons which have been or will be deleted are those coding for sugar and amino acid transport proteins, unlikely to be needed in defined minimal media say for biopharmaceutical production.

To monitor efficiency of the recombinant protein transportation into PS, either of three commercially available tags: *E. coli* alkaline phosphatase, *Aequoria* green fluorescent protein (GFP) or human growth hormone protein may be used according to the methods described above. The human growth hormone protein is useful for final demonstration purposes and will be used in ELISA and gene chip-based measurements of the recombinant protein localization to PS.

One can test the consequence of deleting one or several genes or other DNA sequences from the genome. For example, after one or several genes or other DNA sequences of the genome have been deleted, one can measure the survival and proliferation rate of the resultant bacteria. Although most of the above-identified genes or other DNA sequences may be deleted without detrimental effect for purpose of producing a desired product, it is possible that the deletion of a specific gene or other DNA sequence may have an unacceptable consequence such as cell death or unacceptable level of reduction in proliferation rate. This possibility exists because of redundancies in gene functions and interactions between biological pathways. Some deletions that are viable in a strain without additional deletions will be deleterious only in combination with other deletions. The possibility exists also because of certain methods used to identify deletion candidates. For example, one method used to identify deletion candidates is to compare two *E. coli* strains and select genes or other DNA sequences that are not present in both strains. While the majority of these genes and other DNA sequences are not likely to be functionally essential, some of them may be important for a unique strain. Another method used to identify deletion candidates is to identify non-transcribed regions and the possibility exists that certain non-transcribed regions may be important for genome stability.

The consequence of deleting one or several genes or other DNA sequences to be tested depends on the purpose of an application. For example, when high production efficiency is the main concern, which is true for many applications, the effect of deletions on proliferation rate and medium consumption rate can be the consequence tested. In this case, the consequence tested can also be more specific as the production speed quantity and yield per cell of a particular product. When eliminating native protein contamination is the main concern, fewer native proteins and lower native protein levels, or the absence of a specific native protein, can be the consequence tested.

Testing the consequence of deleting a gene or other DNA sequence is important when little is known about the gene or the DNA sequence. Though laborious, this is another viable method to identify deletion candidates in making a bacterium with a reduced genome. This method is particularly useful when candidates identified by other methods have been deleted and additional candidates are being sought.

When the consequence of deleting a gene or other DNA sequence has an effect on the viability of the bacteria under a set of conditions, one alternative to not deleting the specific gene or other DNA sequence is to determine if there are measures that can mitigate the detrimental effects. For example, if deleting lipopolysaccharide (LPS) genes results in poor survival due to more porous cellular membranes caused by the absence from the cellular membranes of the transmembrane domain of the LPS proteins, culture conditions can be changed to accommodate the more porous cellular membranes so that the bacteria lacking the LPS genes can survive just as well as the bacteria carrying the LPS genes.

Methods for deleting DNA sequences from bacterial genomes that are known to one of ordinary skill in the art can be used to generate a bacterium with a reduced genome. Examples of these methods include but are not limited to those described in Posfai et al., 1997; Muyrers et al., 1999; Datsenko et al., 2000; and Posfai et al., 1999, all of which are hereby incorporated by reference in their entirety. Basically, the deletion methods can be classified to those that are based on linear DNAs and those that are based on suicide plasmids. The methods disclosed in Muyrers et al., 1999 and Datsenko et al., 2000, are linear DNA-based methods and the methods disclosed in Posfai et al., 1997 and Posfai et al., 1999, are suicide plasmid-based methods.

Some known methods for deleting DNA sequences from bacterial genomes introduce extraneous DNA sequences into the genome during the deletion process and thus create a potential problem of undesired homologous recombination if any of the methods is used more than once in a bacterium. To avoid this problem, scarless deletion methods are used. By scarless deletion, the inventors mean a DNA sequence is precisely deleted from the genome without generating any other mutations at the deletion sites and without leaving any inserted DNA in the genome of the organism. However, due to mistakes, such as those made in PCR amplification and DNA repairing processes, one or two nucleotide changes may be introduced occasionally in scarless deletions. Described below are some novel scarless deletion methods, either linear DNA-based or suicide plasmid-based. These novel methods have been applied to E. coli strains in the examples described below. It is understood that the specific vectors and conditions used for E. coli strains in the examples can be adapted by one of ordinary skill in the art for use in other bacteria. Similar methods and plasmids can be used to similar effect in higher organisms. In some instances it may be more appropriate to modify an existing production strain rather than transfer production to the minimized genome E. coli strain.

The methods of the present invention are not limited to use in reducing the genome of bacteria, for example, the present methods may be used to delete DNA from bacteriophage such as P1, P2, lambda and other bacteriophage. Such methods permit the engineering of bacteriophage genomes so as to improve their useful properties and/or to decrease or eliminate certain properties which impair the use of such bacteriophage for a variety of purposes. Similarly, the methods of the present invention are useful for modifying plasmids that reside in bacteria so as to eliminate harmful elements (e.g., virulence genes) from the plasmid and to improve other useful properties of the plasmids.

The well known generalized transducing bacteriophage P1 has been as described above for transducing pieces of DNA into recipient E. coli. Certain gene features of P1, however, ultimately limit the capacity to pick up and package genomic DNA for transduction. In particular, the packaging site (pac) site of P1 is a GATC rich region which when methylated by the dam methylase of P1 limits the amount of genomic DNA into the phage coat. However in the absence of dam associated methylation of the packaging site, packaging of DNA becomes "sloppy," that is, it more readily packages portions of genomic DNA than would be the case if the packaging site were methylated. Therefore, it would be advantageous to engineer the P1 genome to remove dam gene using the deletion methods of the present invention thereby enhancing the ability to pick up and package genomic material.

Another drawback associated with the use of P1 transduction in that the phage carries two insertion sequences. On insertion sequence, IS1 is found between ssb and the prt loci of the P1 genome. Another, IS5 is in the res gene As a result, it is possible that when P1 is used in transduction that one or more of the insertion sequences could end up jumping into a genomic locus of the organism. Therefore, it would be advantageous to engineer the P1 genome to delete the IS sequences using the methods of the present invention thereby preventing genomic contamination where P1 is used as a transduct.

In the above description, the present invention is described in connection with specific examples. It will be understood that the present invention is not limited to these examples, but rather is to be construed to be of spirit and scope defined by the appended claims.

Among the embodiments of the present invention is a *Shigella flexneri* having a reduced genome. Recently, the complete genome sequence of *Shigella flexneri* 2a strain 2457T was determined (the sequenced strain was redeposited at the American Type Culture Collection, as accession number ATCC 700930). The genome of *S. flexneri* consists of a single-circular chomosome of 4,599,354 base pairs (bp) with a G+C content of 50.9%. Base pair 1 of the chromosome was assigned to correspond with base pair one of *E. coli* K-12 since the bacteria shows extensive homology. The genome was shown to about 4082 predicted genes with an average size of 873 base pairs. The *S. flexneri* genome exhibits the backbone and island mosaic structure of *E. coli* pathogens albeit with much less horizontally transferred DNA and lacks 357 genes present in *E. coli* (see, Perna et al., 2001). The organism is distinctive in its large complement of insertion sequences, several genomic rearrangements, 12 cryptic prophages, 372 pseudogenes, and 195 *Shigella* specific genes. The completed annotated sequence of *S. flexneri* was deposited at GenBank accession number AE014073 which is incorporated herein by reference (see also "Complete Genome Sequence and Comparative Genomics of *Shigella flexneri* Serotype 2A strain 2457T", Wei et al., submitted for publication). It is striking to note that based on its DNA sequence, *Shigella* is phylogenetically indistinguishable from *E. coli*.

As is readily apparent from this disclosure, having the *S. flexneri* sequence in hand, its genome may be readily reduced using the methods and gene selection paradigms discussed herein. A reduce genome *Shigella* may be useful for the expression of heterologous (recombinant) proteins or other useful nutrients for reasons discussed herein with respect to reduced genome *E. coli* (live vaccine). Another use for reduced genome *Shigella* or for that matter any pathogenic bacteria susceptible to the deletion methods of the present invention is as a vehicle for the display or presentation of antigens for the purpose of inducing an immune response from a host. Such an engineered *Shigella* could, for example, have genes responsible for virulence deleted from the organism while maintaining other genes such as those encoding antigenic determinants sufficient to induce an immune response in a host and particularly a mucosal immune response in the intestinal wall of a host.

*Shigella flexneri* is potentially well suited for this strategy in that its virulence determinants have been characterized and have been localized to a 210-kb "large virulence (or Invasion) plasmid" whose nucleotide sequence has been determined and has been deposited as GenBank Accession No. AF348706 which is incorporated herein by reference (see also Venkatesan et al., 2001). Among the likely candidates for deletion from the Invasion plasmid is the cadA gene which encodes lysine decarboxylase.

The deleted *Shigella* invasion plasmid may be introduced into a reduced genome *E. coli* thereby allowing efficient expression of certain *Shigella* invasion plasmid genes capable of giving rise to an immune response in a host inoculated with the *E. coli*. The invasion plasmid may also be engineered to delete harmful genes from the plasmid such as the genes responsible for vacuole disruption. Particular candidate genes for removal from the invasion plasmid include one or more genes selected from the group consisting of ipaA, ipaB, ipaC, ipaD and virB. The present invention also allows the addition of other genes to the reduced genome-*E. coli* into which the invasion plasmid has been introduced so as to optimize expression of genes from the introduced, modified invasive plasmid.

The present invention is also directed to live vaccines comprising a reduced genome, for example, *E. coli*, or a reduced genome, for example, *E. coli* into which has been introduced genes encoding antigens capable of inducing an immune response in a host who has been inoculated with the vaccine. Reduced genome vaccines may be DNA based vaccines in containing a DNA known to be capable of inducing a desired physiological response in a hose (i.e., immune response).

One of the major advantages of a reduced genome organism according to the present invention is to provide a clean, minimal genetic background into which DNAs may be introduced to not only allow expression of a desired molecule, but it also affords the opportunity to introduce additional DNAs into the clean background to provide a source of molecules capable of optimizing expression of the desired product.

Deletion Methods
Construction of a Linear Targeting DNA

An example of the construction of a linear target DNA is as follows: To generate primer a+b (FIG. 1), 20 pmol of primer a was mixed with 20 pmol of primer b and PCR was performed in a total volume of 50 µl. Cycle parameters were: 15×(94° C. 40 sec/57° C. or lower [depending on the extent of overlap between primers a and b] 40 sec/72° C. 15 sec). Next 1 µl of this PCT product was mixed with 20 pmol of primers a and c (FIG. 1) each, 50 ng of pSG76-CS template and a second round of PCT was performed in a volume of 2×50 µl. cycle parameters were: 28×(94° C. 40 sec/57° C. 40 sec/72° C. 80 sec). The resulting, PCR-generated linear DNA-fragment was purified by Promega Wizard PCT purification kit, and suspended in 20 µl water. Elimination of the template plasmid (e.g., by DpnI digestion) is not needed. pSG76-CS serves as a template plasmid to generate linear targeting fragments by PCT. It contains the chloramphenicol resistance (CmR) gene and two I-SceI sites, and was obtained by the PCT-mediated insertion of a second I-SceI sites, and was obtained by the PCT-mediated insertion of a second I-SceI recognition site into pSG76-C, downstream of the NotI site. The two I-SceI sites are in opposite orientation.

Novel Linear DNA-Based Scarless Deletion Method I

Figure 2:
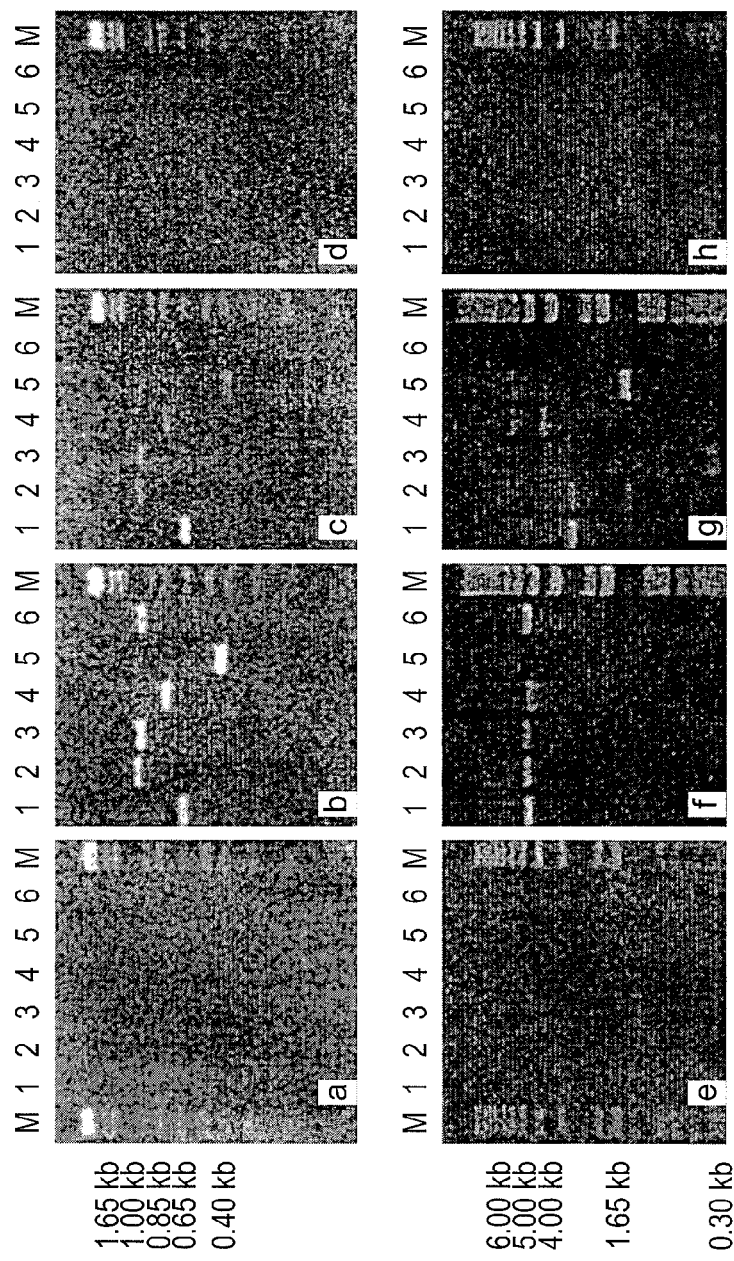
FIG. 2 illustrates a specific example of a linear DNA-based scarless genetic modification method of the present invention.

The novel DNA-based scarless deletion method of the present invention can be best understood when the following description is read in view of FIG. 2. Generally speaking, the method involves replacing a segment of the genome, marked for deletion, with an artificial DNA sequence. The artificial sequence contains one or more recognition sites for a sequence-specific nuclease such as I-SceI, which cuts at a sequence that does not occur natively anywhere in the *E. coli* K-12 genome. Precise insertion of the linear DNA molecule into the genome is achieved by homologous recombination aided by a system that can increase the frequency of homologous recombination. When the sequence-specific nuclease is introduced into the bacteria, it cleaves the genomic DNA at the unique recognition site or sites, and only those bacteria in which a homologous recombination event has occurred will survive.

Referring specifically to FIG. 2, the plasmid pSG76-CS is used as a template to synthesize the artificial DNA insert. The artificial insertion sequence extends between the sequences designated A, B and C in FIG. 2. The $C^R$ indicates a gene for antibiotic resistance. The insert DNA is PCR amplified from the plasmid and electroporated into the *E. coli* host. The insert was constructed so that the sequences A and B match sequences in the genome of the host which straddle the proposed deletion. Sequence C of the insert matches a sequence in the host genome just inside sequence B of the host genome. Then the bacteria are selected for antibiotic resistance, a selection which will be survived only by those bacteria in which a homologous recombination event occurred in which the artificial DNA inserted into the bacterial genome. This recombination event occurs between the pairs of sequences A and C. The inserted DNA sequence also includes a sequence B, now positioned at one end of the insert, which is designed to be homologous to a sequence in the genome just outside the other end of the insert, as indicated in FIG. 2. Then, after growth of the bacteria, the bacteria is transformed with a plasmid, pSTKST, which expresses the I-SceI sequence-specific nuclease. The I-SceI enzyme cuts the genome of the bacteria, and only those individuals in which a recombination event occurs will survive. 10-100% of the survivors are B to B recombination survivors, which can be identified by a screening step. The B to B recombination event deletes the entire inserted DNA from the genome, leaving nothing behind but the native sequence surrounding the deletion.

To repeat, the first step of the method involves providing a linear DNA molecule in a bacterium. The linear DNA molecule contains an artificial linear DNA sequence that has the following features: one end of the linear DNA sequence is a sequence identical to a genome sequence on the left flank of the genome region to be deleted, followed by a sequence identical to a genome sequence on the right flank of the genome region to be deleted; the other end of the linear DNA molecule is a sequence identical to a genome sequence within the genome region to be deleted; between the two ends of the linear DNA, there is a recognition site that is not present in the genome of the bacterial strain and an antibiotic selection gene. The artificial DNA sequence can be made using polymerase chain reaction (PCR) or directed DNA synthesis. A PCR template for this purpose contains the unique recognition site and the genomic DNA sequences on both ends of the artificial linear DNA sequence are part of the primers used in the PCR reaction. The PCR template can be provided by a plasmid. An example of a plasmid that can be used as a template is pSG76-C (GenBank Accession No. Y09893), which is described in Posfai et al. (1997). pSG76-CS (GenBank Accession No. AF402780), which is derived from pSG76-C, may also be used. pSG76-CS contains the chloramphenicol resistance ($Cm^R$) gene and two I-SceI sites, and was obtained by the PCR-mediated insertion of a second I-SceI recognition site into pSG76-C, downstream of the NotI site. The two I-SceI sites are in opposite direction.

An artificial or constructed DNA sequence can be provided to a bacterium by directly introducing the linear DNA molecule into the bacterium using any method known to one of ordinary skill in the art such as electroporation. In this case, a selection marker such as an antibiotic resistance gene is engineered into the artificial DNA sequence for purpose of selecting colonies containing the inserted DNA sequence later. Alternatively, a linear DNA molecule can be provided in a bacterium by transforming the bacterium with a vector carrying the artificial linear DNA sequence and generating a linear DNA molecule inside the bacterium through restriction enzyme cleavage. The restriction enzyme used should only cut on the vector but not the bacterial genome. In this case, the artificial linear DNA sequence does not have to carry a selection marker because of the higher transformation efficiency of a vector so that a bacterium with the inserted linear DNA can be screened by PCR later directly.

The second step of the scarless deletion method involves replacement of a genomic region by insertion of the artificial DNA molecule. The bacterial cells are engineered to contain a system that increases the frequency of homologous recombination. An example of such a system is the Red recombinase system. The system can be introduced into bacterial cells by a vector. The system helps the linear DNA molecule to replace a genomic region which contains the deletion target. As described in the examples below, a vector carrying a homologous recombination system that can be used in *E. coli* is pBADαβγ, which is described in Muyrers et al. (1999). Another plasmid pKD46 described in Datsenko et al. (2000) may also be used. Other plasmids that can be used include pGPXX and pJGXX. pGPXX is derived from pBADαβγ by replacing the origin of replication in pBADαβγ with pSC101 origin of replication. pJGXX is a pSC101 plasmid that encodes the Red functions from phage 933W under tet promoter control The third step of the scarless deletion method involves removal of the inserted DNA sequence. An expression vector for a sequence-specific nuclease such as I-SceI that recognizes the unique recognition site on the inserted DNA sequence is introduced into the bacteria. The sequence-specific nuclease is then expressed and the bacterial genome is cleaved. After the cleavage, only those cells in which homologous recombination occurs resulting in a deletion of the inserted linear DNA molecule can survive. Thus, bacteria with a target DNA sequence deleted from the genome are obtained. Examples of sequence-specific nuclease expression vectors that can be used in *E. coli* include pKSUC1, pKSUC5, pSTKST, pSTAST, pKTSHa, pKTSHc, pBADScel and pBADSce2. The sequence-specific nuclease carried by these vectors is I-SceI. pKSUC1, pKSUC5, pSTKST and pSTAST are described below in the examples.

The method described above can be used repeatedly in a bacterium to generate a series of deletions. When the expression vector for the homologous recombination system and the expression vector for the unique sequence-specific nuclease are not compatible with each other, such as the case for pBADαβγ and pKSUC1, transformation of the two vectors have to be performed for each deletion cycle. Transformation of the two vectors can be avoided in additional deletion cycles when two compatible plasmids, such as pBADαβγ and pSTKST, or pKD46 and pKSUC5, are used. An example of using two of these vectors that are compatible with each other is described in the examples below.

The above scarless deletion method can be modified to make a series of deletions on a bacterial genome more efficient (an example of which is Procedure 4 in Examples below). The first step of the modified method involves making insertions of a linear DNA molecule individually in bacterial cells, particularly wild-type bacteria cells, in a parallel fashion, resulting in a set of strains, each carrying a single insertion. This step can be carried out as described above. The second step of the modified method involves sequentially transferring individual insertions into the target cell whose genome is to be reduced. P1 transduction is an example of the methods that can be used for transferring insertions. The third step of the modified method involves recombinational removal of the inserted sequence, which can be carried out as described above.

Novel Linear DNA-Based Scarless Deletion Method II

In this novel linear DNA-based method, two DNA sequences, one of which is identical to a sequence that flanks one end of a bacterial genome region to be deleted and the other of which is identical to a sequence that flanks the other end of the bacterial genome region and oriented similarly, are engineered into a plasmid vector. The vector is herein termed the target vector. The two DNA sequences are located next to each other on the target vector. At least one recognition site for an enzyme that will only cut the target vector but not the bacterial genome is also engineered into the target vector at a location outside the two DNA sequences. The recognition site can be one for a sequence-specific nuclease such as I-SceI. The recognition site can also be one for a methylation-sensitive restriction enzyme that only cuts an unmethylated sequence. Since the recognition site, if there is any, on the bacterial genome is methylated, the restriction enzyme can only cut the target vector. The target vector is transformed into a bacterium and a linear DNA molecule is generated inside the bacterium by expressing in the bacterium the enzyme that recognizes and cuts the recognition site on the target vector. Next, a system that can increase homologous recombination is activated inside the bacterium to induce homologous recombination between the homologous sequences of the linear DNA and the bacterial genome that flank the region to be deleted. A bacterium with a targeted genome region deleted can be obtained as a result of the above homologous recombination.

This novel linear DNA-based method can also be used to replace a region of a bacterial genome with a desired DNA sequence. In this case, a desired DNA sequence that can undergo homologous recombination with the bacterial genome to replace a region on the genome is engineered into the target vector. All other aspects are the same as described above for deleting a region of the bacterial genome.

Regardless whether the method is used to delete or replace a target region in the bacterial genome, a marker gene for selecting incorporation of DNA carried on the target vector into the bacterial genome is not necessary due to the high incorporation efficiency. Simply screening 30-100 colonies by PCR usually allows the identification of a clone with desired modification in the bacterial genome.

Figure 3A:
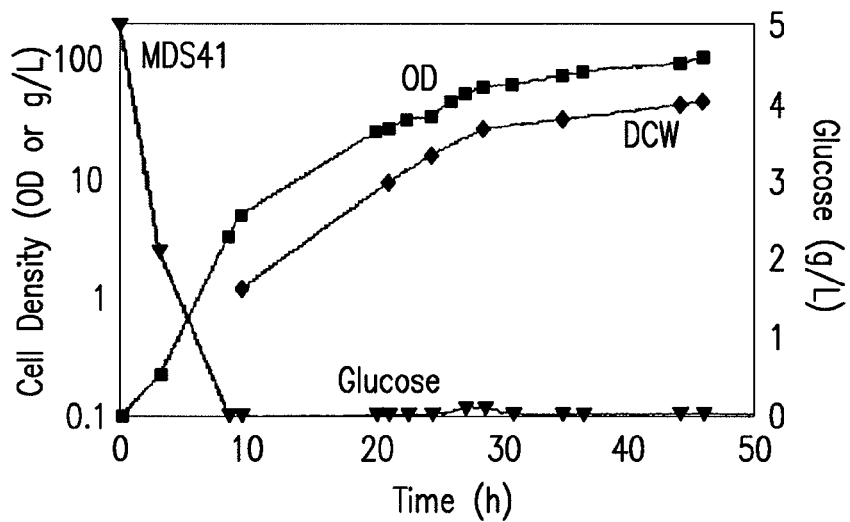
FIGS. 3A-B illustrate specific examples of another linear DNA-based method of the present invention.
Figure 3B:
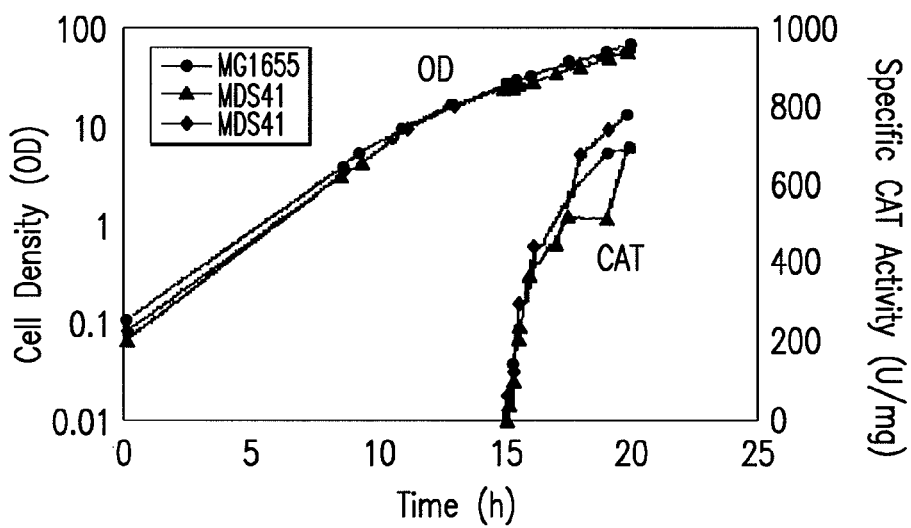
Figure 4A:
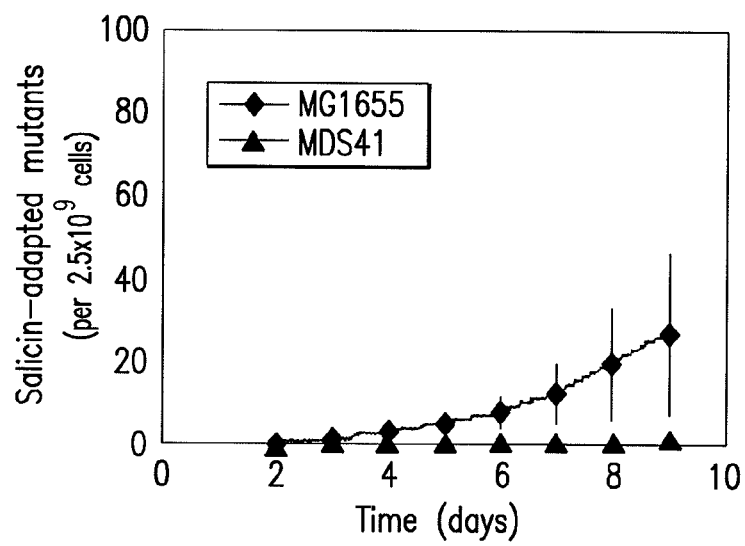
FIGS. 4A-B show a mutagenesis plasmid that can be used in the linear DNA-based method illustrated in FIGS. 3A-B.
Figure 4B:
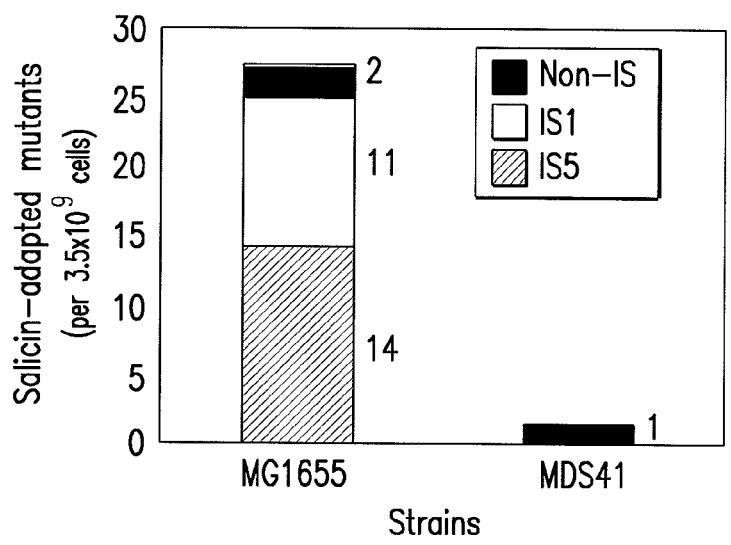

As a specific example, FIGS. 3 and 4 illustrates using this method for introducing an Amber stop codon in the middle of a gene. As a first step, a DNA fragment with the desired modifications located near the middle of the gene or chromosomal region is produced. A sequence-specific nuclease I-SceI recognition site is introduced at one side of the DNA fragment. This can be easily accomplished by including the sequence in the 5' end of PCR primers used to amplify the DNA fragment. Longer DNA fragments (500-5,000 nucleotides) generally work the best.

The DNA fragment is cloned into a multi-copy target plasmid vector such as pUC19 (GenBank accession No. M77789). Since this target vector is used along with a mutagenesis vector as described below, the target vector is engineered to be compatible with p15A origin plasmids (pACYC184-derived; GenBank accession No. X06403) and has a drug resistance marker other than chloramphenicol. These restrictions can be easily avoided by using an alternate mutagenesis plasmid.

As illustrated in FIG. 4, the mutagenesis plasmid used in this example contains the sequence-specific nuclease I-SceI and the lambda red genes exo, beta and gam under control of the P-BAD promoter. The plasmid also contains p15Aori and chloramphenicol resistance gene.

The target and the mutagenesis plasmids are transformed into a recA positive *E. coli*. The bacteria are selected for resistance to chloramphenicol and the resistance carried on the target plasmid. A single colony is then picked and cultured at 37° C. for about 7.0 hours in 1 ml of Rich Defined Media (Neidhardt et al., 1974, which is hereby incorporated by reference in its entirety) containing 0.2% arabinose and chloramphenicol. A series of dilutions (for example, 1:1,000, 1:10,000 and so on) of cultures is then plated on a non-selective medium such as LB. Next, the colonies are screened for desired mutations. If a growth phenotype is known, the screening can be done by patching on appropriate media. Otherwise, the screening is done with colony PCR followed by restriction digestion and electrophoresis or by sequencing.

Suicide Plasmid-Based Method

The suicide plasmid-based method described here can be used for both scarless gene deletion and gene replacement. The basic element of the method involves a plasmid vector named Interlock plasmid that contains an antibiotic resistance gene and a replication origin under the control of a promoter. The Interlock plasmid also contains one or more sites at which a DNA insert can be inserted. When the method is used for scarless deletion, the DNA insert includes two DNA sequences located right next to each other, oriented similarly, one of which is identical to a sequence that flanks one end of a bacterial genome region to be deleted and the other of which is identical to a sequence that flanks the other end of the bacterial genome region. When the method is used for gene replacement, the DNA insert includes a sequence that will replace a segment of a bacterial genome. When the promoter that controls the origin of replication is turned off, the replication of the plasmid is shut down and the antibiotic pressure can be used to select for chromosomal integrations at the site of the flanking region. After chromosomal integration at the site of the flanking region, the promoter that controls the replication origin from the plasmid can be turned on and the only bacteria that can survive are those in which a recombination event has occurred to eliminate said origin of replication, its promoter or both. When the DNA insert is for making scarless deletion, recombination between the integrated insert and the corresponding region in the genome will result in bacteria that either have the desired scarless deletion or the same genome before any integration. When the DNA insert is for gene replacement, recombination will result in bacteria that either have the desired replacement or the same genome before any integration. A screening step can then be performed to identify those bacteria with desired modifications in the genome.

A variation of the above method involves the same Interlock plasmid except that the plasmid also contains a sequence-specific nuclease recognition site that is absent in the bacterial genome. After chromosomal integration, instead of activating the origin of replication control promoter to select for recombination events, the bacteria are engineered to express the sequence-specific nuclease to cut the bacterial genome and select for recombination events.

The suicide plasmid-based method can also be used repeatedly in a similar fashion as the novel liner DNA-based methods described above to generate a series of deletions on a bacterial genome.

Figure 5:
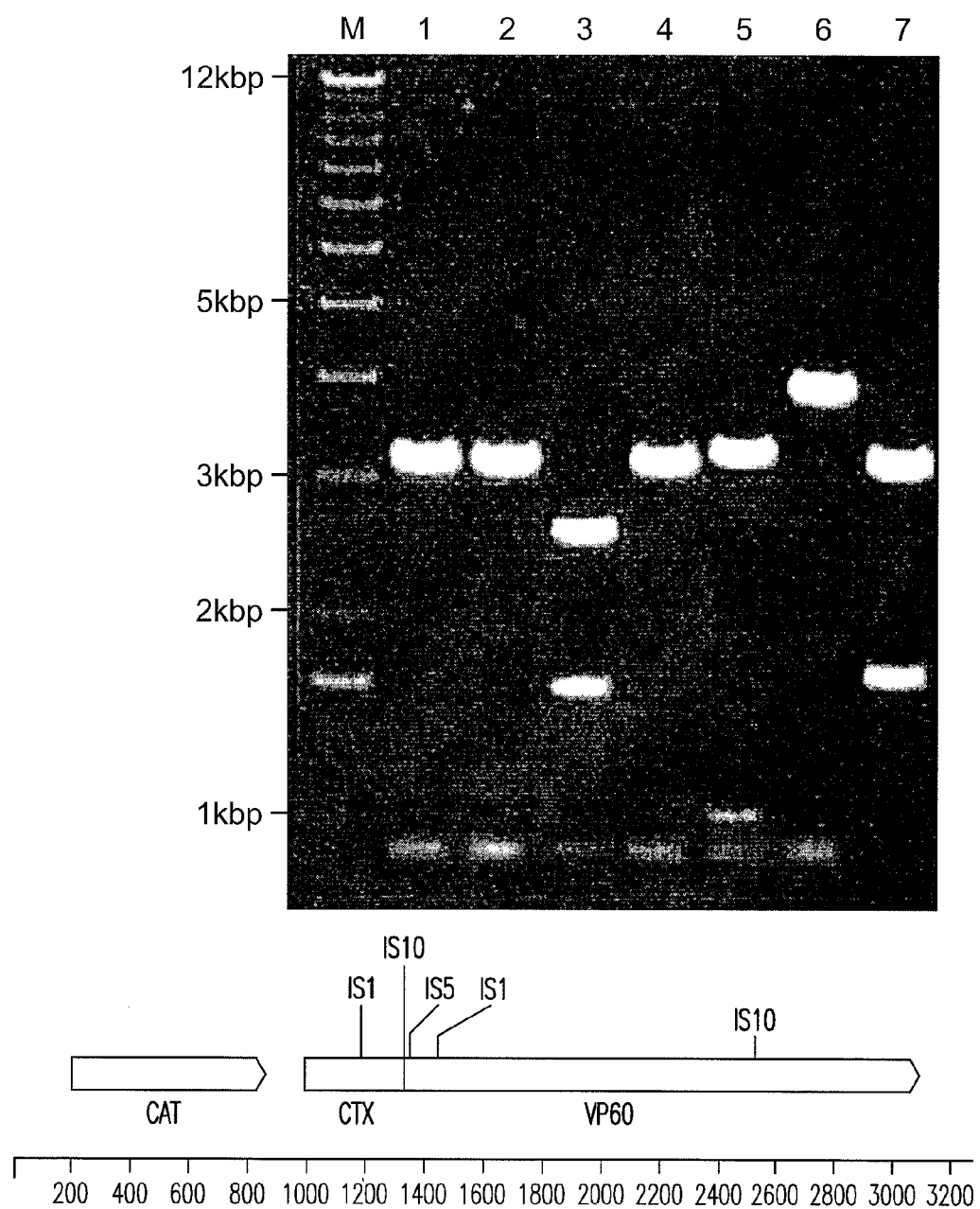
FIG. 5 illustrates a specific example of a suicide plasmid-based method of the present invention.
Figure 6:
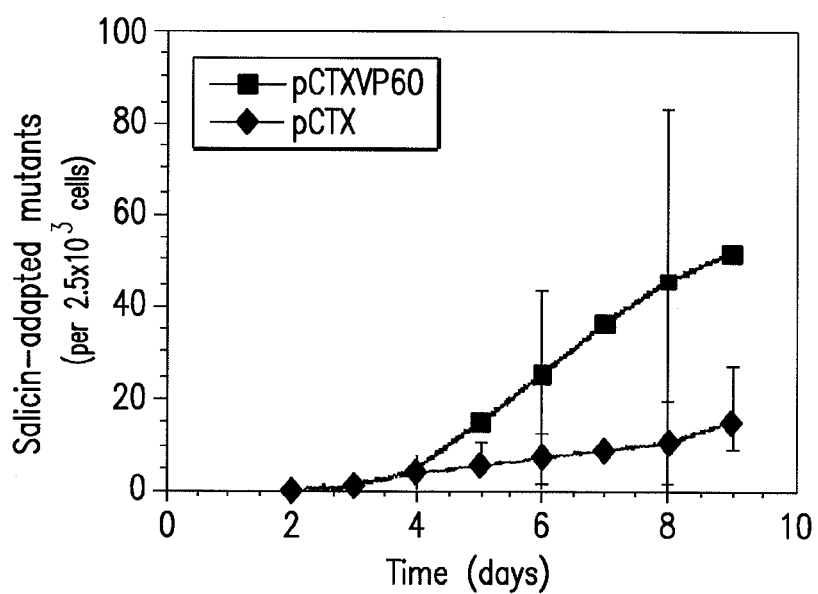
FIG. 6 shows three plasmids that can be used in the suicide plasmid-based method illustrated in FIG. 5.

FIG. 6 shows plasmid embodiments that can be used in the suicide plasmid-based method. pIL1 is an Interlock plasmid and pBAD-Sce-1 is a plasmid for expressing a sequence-specific nulcease I-SceI. pIL4 is a combination of both. The tet promoter used in pIL1 and pIL4 is tightly regulated and thus has advantages over other control mechanisms such as a temperature sensitive element which is more leaky. An example of using pIL4 for gene replacement is shown in FIG. 5 to illustrate the suicide plasmid-based method of the present invention. FIG. 5 shows that the insertion of a DNA insert into pIL4 and integration of pIL4 into the bacterial genome. With heat activated chlortetracycline (CTC), tet repressor is inactive, the 0 and P promoter is functional, and the plasmid replicates. After removing CTC, tet repressor binds the promoter for 0 and the P promoter and the replication is blocked. Chloramphenicol resistance can be used to select for integrants. FIG. 5 shows using the induction of the ectopic origin to select for homologous recombination and two possible outcomes of the homologous recombination. FIG. 5 shows the alternative way of selecting for homologous recombination and the two possible outcomes of the recombination. This alternative way involves inducing I-SceI expression to generate double-strand break.

Two specific embodiments of the suicide plasmid-based method are described below as protocol 1 and protocol 2. Either pIL1 or pIL4 can be used for protocol 1, and pIL1 in combination with pBAD-Sce-1 can be used for protocol 2. One of ordinary skill in the art can also adapt protocol 2 for using pIL4 alone.

Protocol 1 (Counterselection with Lambda Origin):

1. Generate the desired genomic modification as a linear DNA fragment. In the case of making an Amber mutant, the modification can be made by megaprimer PCR. To make a deletion in the genome, a fusion of the desired endpoints of the deletion should be used. The ends of the DNA fragment should be phosphorylated for cloning.
2. Create a blunt cloning site by digesting the pIL4 vector (FIGS. 5A and 6) with the restriction enzyme Srf1. Dephosphorylate the vector.
3. Perform a blunt ligation of the desired modification and the pIL4 vector.
4. (Note: this step is potentially dispensable in high throughput implementation.) Transform the ligation into a cloning strain of *E. coli* (such as JS5). Outgrow the transformation for 1 hour in LB+1 µg/ml cTc (cTc—chlortetracycline freshly autoclaved in LB media. A stock of 100 µg/ml is autoclaved for 20 minutes and then stored in the dark at 4° C. It can be used for up to 5 days. Alternately, a solution of 2 ng/ml of anhydrotetracycline can be substituted). Then plate on LB+Chloramphenicol (Cam 25 µg/ml)+cTc (1 µg/ml), and grow overnight at 37° C. Grow colonies in equivalent media and prepare plasmid miniprep DNA. Analyze by gel electrophoresis and select a clone with an insert.
5. Transform the verified plasmid into a recA positive strain of *E coli* (such as MG1655). Outgrow for 1 hour in LB+1 µg/ml cTc. Plate a portion of the outgrowth on plates containing Cam and 1 µg/ml cTc. Grow overnight at 37° C.
6. Pick a colony into 1 ml LB and plate 10 µl on a Cam plate. Grow overnight at 37° C.
7. Streak a colony on a Cam plate to be sure that every cell present contains the integrated plasmid. Grow overnight at 37° C.
8. Pick a colony into 1 ml LB and plate 100 µl of a 1:100 dilution on plates containing 5 µg/ml cTc. Grow overnight at 37° C.
9. (Screen for mutant) Only a fraction of the counterselected colonies will contain the desired modification and the others will be reversions to wt. The proportion of mutant to revertant will depend on the location of the modification in the cloned fragment. Some kind of screen must be performed to identify the desired mutant. For the production of Amber mutants, the gene in question can be amplified by PCR and digested with BfaI restriction enzyme (BfaI cuts Amber codons that are preceded by a 'C').

Protocol 2 (High Thruput Counterselection with I.SceI):
1-4 Same as protocol 1.
5. Co-transform the insert-carrying Interlock plasmid and pBAD-SceI into a recA positive strain of E coli (such as MG 1655). Outgrow for 1 hour in LB+1 ug/ml cTc. (Alternatively, the insert-carrying Interlock plasmid can be transformed on it's own into competent cells already carrying pBAD-SceI).
6. Add Chlorampehnicol to 25 μg/ml and Kanamycin to 50 μg/ml. Grow for 1-2 hours at 37° C. with shaking.
7. Pellet the cells in a microcentrifuge for 30 seconds. Remove the media supernatant.
8. (Integration step) Resuspend the cells in 1 ml LB+Chloramphenicol (25 μg/ml)+Kanamycin (50 μg/ml)+Glucose (0.2%) and grow overnight at 37° C., shaking.
9. Dilute the overnight culture 1:10,000 in the same media and grow an additional 16-24 hours at 37° C.
10. (Counter selection step) Dilute 10 μl of the culture into 1 ml 1xM9 minimal salts (to minimize growth rate). Split this into two tubes of 0.5 ml each. To one add Arabinose to 0.2% and to the other add Glucose to 0.2% (to serve as a negative control). Grow 1-2 hours at 37° C. with shaking.
11. Plate 10 μl of the Arabinose tube onto LB+Kanamycin (50 μg/ml)+Arabinose (0.2%) and 10 μl of the Glucose tube onto LB+Chloramphenicol (25 μg/ml)+Kanamycin (50 μg/ml)+Glucose (0.2%). Grow overnight at 37° C.
12. (Screen for mutant) Perform step 9 of the primary protocol.

EXAMPLES

The invention is further defined in the following Example(s). It should be understood the Example(s) are given by way of illustration only. From the above discussion and the Example(s), one skilled in the art can ascertain the essential characteristics of the invention, and without departing from the spirit and scope thereof, can make various changes and modifications to adapt the invention to various uses and conditions. As a result, the invention is not limited by the illustrative example(s) set forth hereinbelow, but rather defined by the claims appended hereto.

Example 1

Plasmids

The plasmid used for PCR construction of the artificial inserted DNA sequence was designated pSG76-CS (GenBank Accession No. AF402780), which was derived from pSG76-C (Posfai et al., 1997) by inserting a second I-SceI site. The second I-SceI site was obtained by the PCR-mediated insertion of a second I-SceI recognition site into pSG76-C, downstream of the NotI site. The two I-SceI sites are in opposite direction.

The pBADαβγ plasmid was used for enhancing recombination of linear DNA-fragments into the genome. This plasmid was described in Muyers et al. (1999).

The PKSUC1 plasmid (GenBank Accession No. AF402779), for expressing I-SceI, was derived from pSG76-K (Posfai et al., 1997) and pUC19RP12 (Posfai et al., 1999). The XbaI-NotI fragment (carries the Kan gene; the NotI end was blunted by Klenow polymerase) of pSG76-K was ligated to the XbaI-DraI fragment (carries the I-SceI gene and the pUC ori) of pUC19RP12.

The pKSUC5 plasmid for tetracycline-regulated expression of I-SceI was derived from pFT-K (Posfai et al., 1997) and pKSUC1. The large XbaI-NcoI fragment of pKSUC1 was ligated to the XbaI-NcoI fragment of pFT-K carrying the tet repressor.

The PKD46 plasmid for enhancing recombination of linear DNA-fragments into the genome was described in Datsenko et al. (2000).

The plasmid pSTKST (GenBank Accession No. AF406953) is a low copy number $Kan^R$ plasmid for chlortetracycline-regulated expression of I-SceI, derived from pFT-K (Posfai et al., 1997) and pUC19RP12 (Posfai et al., 1999). The XbaI-PstI fragment from pUC19RP12, carrying the I-SceI gene, was ligated to the large XbaI-PstI fragment of pFT-K. This plasmid expresses I-SceI when induced by chlortetracycline. Replication of the plasmid is temperature-sensitive (Posfai et al., 1997).

The plasmid pSTAST, a low copy number $Ap^R$ plasmid for chlortetracycline-regulated expression of I-SceI, was derived from pFT-A (Posfai et al., 1997) and pUC19RP12 (Posfai et al., 1999). The XbaI-PstI fragment from pUC19RP12, carrying the I-SceI gene, was ligated to the large XbaI-PstI fragment of pFT-A. This plasmid expresses I-SceI when induced by chlortetracycline. Replication of the plasmid is temperature-sensitive (Posfai et al., 1997).

Deletion Procedure 1

This describes the process used to repeatedly make deletions from the genome of E. coli K-12. This procedure is a scarless deletion method. The procedure begins with the construction of a linear target fragment by PCR. This was done by mixing 20 pmol of primer A with 20 pmol primer B, and performing PCR in a total volume of 50 μl. The cycle parameters used were 15×(94° C. 40 sec/57° C. or lower (depending on the overlap of A and B) 40 sec/72° C. 15 sec). The 1 μl of the PCR mix above were taken, added to 20 pmol of primers A and C each, add 50 ng of pSG76-CS and perform PCR in a volume of 2×50 μl (use 50-μl tubes, and two tubes are combined to have more DNA). The cycle parameters used were 28×(94° C. 40 sec/57° C. 40 sec/72° C. 80 sec). To purify the PCR mix from the above step, Promega Wizard PCR purification kit was used. The resulting DNA fragment was suspended in 20 μl water.

Next was the replacement of a genomic region by insertion of the artificial DNA-fragment. This was done by taking the target cell carrying pBADαβγ and preparing electrocompetent cells as described (Posfai et al., 1999), except that 0.1% arabinose was added to the culture 0.25-1 hour before harvesting the cells. 4 μl of DNA fragments (100-200 ng) were electroporated into 40 μl of electrocompetent cells. The cells were plated on Cam plates (25 μg cam/ml) and incubated at 37° C. The usual result was to obtain a total of 10 to several hundred colonies after overnight incubation. A few colonies were checked for correct site insertion of the fragment by PCR using primers D and E.

Next was the deletion of the inserted sequences. This was done by preparing competent cells derived from a selected colony from above by the $CaCl_2$ method (Sambrook et al., 1989). The plasmid pKSUC1 (~100 ng) was transformed into the cells by standard procedures (Sambrook et al., 1989). The cells were plated on Kan plates and incubated at 37° C. (pKSUC1 and pBADαβγ are incompatible, thus selection on Kan eliminates pBADαβγ from the cells). The colonies were checked for correct deletion by PCR using primers D and E. A colony was selected carrying the correct deletion. At this point, the cells carried pKSUC1. The next step is to delete this plasmid.

This deletion is done through the replacement of pKSUC1 with pBADαβγ. A colony from the prior step was selected, grown in LB at 37° C. under nonselective conditions, reinoculating the cells into fresh medium 2-3 times. Competent cells were prepared for either chemical transformation or electroporation. The plasmid pBADαβγ (100-200 ng) was transformed into the competent cells which were plated on Amp plates. A colony which was Kan sensitive/Amp resistant was selected by toothpicking a hundred colonies on Kan and Amp plates.

The selected colony can be used in a next round of deletion by using a new targeting fragment and repeating the steps above. If no more deletions are needed, growing the cells under nonselective conditions (no Amp is added) results in the spontaneous loss of pBADαβγ from a large fraction of the cells.

Deletion Procedure 2

This procedure is similar to procedure 1, but pKSUC1 is replaced by pSTKST. This plasmid is compatible with pBADαβγ, has a temperature-sensitive replicon, and expression of I-SceI requires induction by chlortetracycline (CTC). The advantage is that elimination of pSTKST from the cell is easily accomplished by growing the culture at 42° C.

Construction of a linear targeting fragment by PCR and replacement of a genomic region by insertion of the fragment are done as described in Procedure 1.

To delete the inserted sequences competent cells are prepared from a culture derived from a selected colony harboring the right insertion. Cells are transformed by pSTKST, plated on Kan+Cam plates and incubated at 30° C. A colony from this plate is inoculated into 10 ml of LB+Kan supplemented with heat-treated inducer CTC (25 μg/ml final concentration) and grown at 30° C. for 24 hours. This step serves induction of the expression of I-SceI. Dilutions of the culture are then spread on LB+Kan plates and incubated overnight at 30° C. 6-12 colonies were checked for correct deletion by PCR using primers D and E. A colony was selected carrying the correct deletion.

To eliminate the helper plasmids from the cell, the culture is grown at 42° C. in LB (no antibiotics added).

Procedure 3

Since pBADαβγ and pSTKST carry compatible replicons, repeated transformations of the plasmids are not required when consecutive deletions are made in the same host. The two plasmids are maintained in the host cell throughout consecutive deletion constructions by antibiotic selection (Kan+Amp). Recombinase and specific nuclease functions are induced only when needed. Since replication of pSTKST is temperature-sensitive, cells must be grown at 30° C.

The procedure is identical to Procedure 2, except that pBADαβγ and pSTKST are transformed into the cell only once, and until maintenance of both plasmids in the cell is desired, the culture is grown at 30° C., and Amp+Kan are included in the medium. Note: Sometimes the inventors experienced difficulties in growing the cells at 30° C. in the presence of two (Amp+Kan) or three (Amp+Kan+Cam) antibiotics.

Procedure 4

This is the particular procedure when several consecutive deletions are to be made in the same cell. Insertions (recombination of linear fragments into the genome of a host cell carrying pBADαβγ) are made in parallel, creating a series of recombinant cells, each carrying a single insertion. These insertions are then transferred one by one by P1 transduction into the cell carrying pSTKST and harboring all previous deletions. Removal of all foreign sequences is done in this final host by inducing pSTKST. Compared to the previous methods, the main difference is that the insertion step and removal of the inserted sequences are done in separate cells. Since insertions are made in parallel, the construction of consecutive deletions is faster. Another advantage is that cells are transformed by the plasmids only at the beginning of the first deletion construction.

Technically the procedure is identical to Procedure 2, except that individual insertions are transferred by P1 transduction to the deletion strain already harboring pSTKST. After each P1 transduction step, I-SceI expression is induced to remove the inserted sequences.

Results

Twelve consecutive genomic deletions have been made from *E. coli* strain K-12 MG1655. The twelve deleted regions were selected for deletion, in part, as a result of comparison of the genomic DNA sequences of *E. coli* strain O157:H7 EDL933 and strain K-12 MG1655. The deletions are listed on Table 1 below. The sequence numbering is taken from the published K-12 sequence.

The first deletion MD1 was made using the method described in Posfai et al. (1999). Using this method for creating MD1 deletion left a 114-bp pSG76-CS vector sequence, including a FRT site, in the chromosome at the site of deletion. MD2 through MD6 deletions were made using Procedure 1 described above. Deletions MD7 through MD12 were created using a combination of Procedure 4 and Procedure 1 or 2. Strain designations and genomic coordinates of each new deletion were: MD1 263080-324632; MD2 1398351-1480278; MD3 2556711-2563500; MD4 2754180-278970; MD5 2064327-2078613; MD6 3451565-3467490; MD7 2464565-2474198; MD8 1625542-1650865; MD9 4494243-4547279; MD10 3108697-3134392; MD11 1196360-1222299; MD12 564278-585331.

A total of 378,180 base pairs, which is approximately 8.1% of the native K-12 MG1655 *E. coli* genome, was removed at this stage. Removing these regions from the genome did not affect bacterial survival or bacterial growth.

Table 2 below lists other segments, genes and regions of the *E. coli* genome that were identified as candidates for further deletions. The segments were also successfully removed from the genome of the bacteria. Again, these deletions were made without any apparent deleterious effect on the usefulness of the bacteria for laboratory and industrial use. Again the sequence designations are taken from the published K-12 sequence. The two sets of deletions totaled about 14% of the original bacterial genome. It should be noted that it is possible to delete the genes themselves along with flanking DNA so long as the flanking DNA does not disrupt a gene essential for growth and survival of the host.

In Procedure 1, efficiency of the insertion of the linear fragment varied with the particular genomic locus. Correct-site insertion occurred in 1-100% (normally 20-100%) of the colonies. Flanking homologies in the range of 42 to 74 bp were used. Longer homologies give better insertion efficiencies. Correct-site excision between the duplicated sequences occurred in 1-100% (normally 10-100%) of the colonies and depended on the length of the duplicated region. Longer duplications are usually more effective. Length of the duplicated sequences was in the range of 42 to 50 bp. Variations in the efficiencies of insertion and excision existed between seemingly identically repeated experiments and are not fully understood yet.

Procedure 3 was tested by re-creating deletion MD2. Correct-site insertion of the linear DNA-fragment occurred in 6.6% of the colonies. Deletion of the inserted sequence was very efficient. Twenty-five resulting colonies were replica plated on Cam+Amp+Kan and Amp+Kan plates, and 19 of them proved to be Cam sensitive. Five of these colonies were then tested by PCR, and all 5 showed the predicted loss of the inserted sequence.

Table 8 and Table 9 show a more precise description of the deletion endpoints of genes that have been or will be deleted from the landmark. *E. coli* strains MDS12, MDS40 and MDS73 (Tables 8 and 9) are the endpoints of the deletions for intermediate strains that were used to construct the landmark strains. The genes listed in Table 9 identified by "b" numbers and are based on the designations set out in Blattner et al., *Science*, supra and in GenBank Accession No. 400096. The numbering in Table 8 is also based on Blattner et al. supra.

Characterization of Deletion Strains

Transformation Frequency

It is desirable to incorporate exogenous DNA into the genome of *E. coli* deleted strains in such a way that host bacterial cells will maintain the integrated DNA as they divide and grow. The process of exogenous DNA introduction into bacterial host genome is called transformation and organisms who harbor exogenous DNA are called transformed organisms. There is need in the art for *E. coli* strains with high efficiency of transformation.

*E. coli* strain MDS39 was constructed by making 39 deletions (approximately 14.1% of the genome) in parental *E. coli* strain MG1655 and was found to be efficiently transformed by electroporation. This high efficiency of transformation extended to intake of a large size BAC (Bacterial Artificial Chromosome) DNA, which makes the strain MDS39 particularly valuable for the wide range of applications.

To test the transformation efficiency of *E. coli* strain MDS39 in harboring and stably maintaining exogenous DNA, three strains: DH10B, MDS31 and MDS39 were grown under standard growth conditions to optical density of 0.5 at 600 nm. Cell cultures were spun down, cell pellets were washed several times with water and finally resuspended in water (at 1/1000 of the original culture volume). 25 ng of either pBR322DNA or methylated BAC DNA or unmethylated BAC DNA was added to 100 µl of the cell suspension and subjected to electroporation using standard electroporation protocol, e.g., 1.8 kV and resistance of 150 ohms in a 0.1 cm electroporation cuvette using an Invitrogen Electroporator II™ device. BAC DNA methylated at the EcoK sites and pBR322DNA were prepared in *E. coli* strain MG1655 using standard protocols. Unmethylated BAC DNA was prepared in *E. coli* strain DH10B.

Table 3 shows that both strains, MDS31 and MDS39, are efficiently transformed by pBR322DNA with molecular weight of 4,363 base pairs and by methylated BAC DNA with molecular weight of 100,000 base pairs. The efficiencies of transformation with methylated BAC DNA for strains MDS31 and MDS39 are comparable with the efficiency of transformation for strain DH10B which is currently regarded as one of the strains with the best transformation efficiency.

When transformed with unmethylated BAC DNA, the efficiency of transformation for strain MDS39 was higher than the efficiency of transformation for strain DH10B (Table 3), while the efficiency of transformation for strain MDS31 was lower then the efficiencies of transformation for both strains MDS39 and DH10B. The low efficiency of transformation for strain MDS31 is due to the fact that the unmethylated DNA is a subject to restriction in the strain because MDS31 is a $r^+m^+$ strain, while both strains DH10B and MDS39 are $r^-m^-$ strains.

Recent work with MDS39 revealed the possible presence of a residual insertion sequence IS5 in sequence gb_ba:ecu 95365. In order to determine the effect of deleting of deleting the resident IS sequence from MDS39, procedures described herein were used to delete the sequence. The endpoints of the deletions in MDS40 are strains in Tables 8 and 9. The resulting strain MDS40 was then tested for its transformation offering and growth characteristics (Results) as discussed below.

Electroporation-competent cells were prepared as described in the Invitrogen Electroporator II Manual. Briefly, a 200-ml culture was grown to $OD_{550}$=0.5, then cells were harvested by centrifugation and washed twice in ice-cold water and once in ice-cold 10% glycerol by repeated centrifugation and suspension. At the final step the cell pellet was suspended in 0.4 ml 10% glycerol, aliquoted in 40 µl portions and stored at −80° C.

The cells were typically electroporated with 10-100 ng quantities of plasmid DNA at 1.8 kV and a resistance of 150Ω in a 0.1-cm electroporation cuvette using the Electroporator II device (Invitrogen). Cells were then diluted with 1 ml LB, incubated in a shaker for 1 h, and plated on selective medium.

Several experiments were done, results may vary by an order of magnitude. The average of 2 typical, independent experiments (2 parallels each) are shown in Table 5.

Transformation efficiencies for MG1655, MDS40 and DH10B used chemical transformation methods were also used. Competent cells were prepared by a simple method. A 50-ml culture was chilled and harvested by centrifugation at $OD_{550}$=0.4, then washed twice with 1/20 volume of ice-cold $CaCl^2$ solution (10 mM Tris pH 7.5, 15% glycerol, 60 mM $CaCl_2$) with repeated centrifugation and suspension. Cells were then incubated on ice for 1 h, aliquoted in 200-µl portions and stored at −80° C.

For transformation, cells were typically mixed with 100 ng plasmid DNA, incubated on ice for 30 min, heat-shocked at 42° C. for 2 min, then 0.8 ml LB was added. Cells were incubated at 37° C. for 0.5-1 h, then dilutions were plated on selective medium. Results are shown in Table 6.

Growth Characteristics

As discussed above it is desirable that deletion strains prepared by the methods of the present invention have a robust ability to grow under certain culture conditions. Growth studies were conducted as follows.

Comparison of *E. coli* strain cell doubling time in minutes at 37° C. was measured with a 96-well plate reader (SpectraMax plus, Molecular Devices) with shaking. The log linear portion of the growth curve was used to calculate the average doubling times and standard deviation from six replicates on the plate. This device, while providing a convenient way to do comparative measurements does not areate the cells very well so the rates of growth about twice as slow as obtained with shake flasks.

It is evident the deletion strains grow at the same rate in minimal medium as the original MG1655 but not to the same ultimate density. The deletions grow less rapidly but the same ultimate density on rich defined medium. It will be interesting to examine the reasons for these small differences, but the objective of reducing the genome substantially while preserving the ability to grow robustly in minimal medium has clearly been achieved.

Example 2

Stress-Induced Reactivation of Cryptic Prophage

Figure 7:
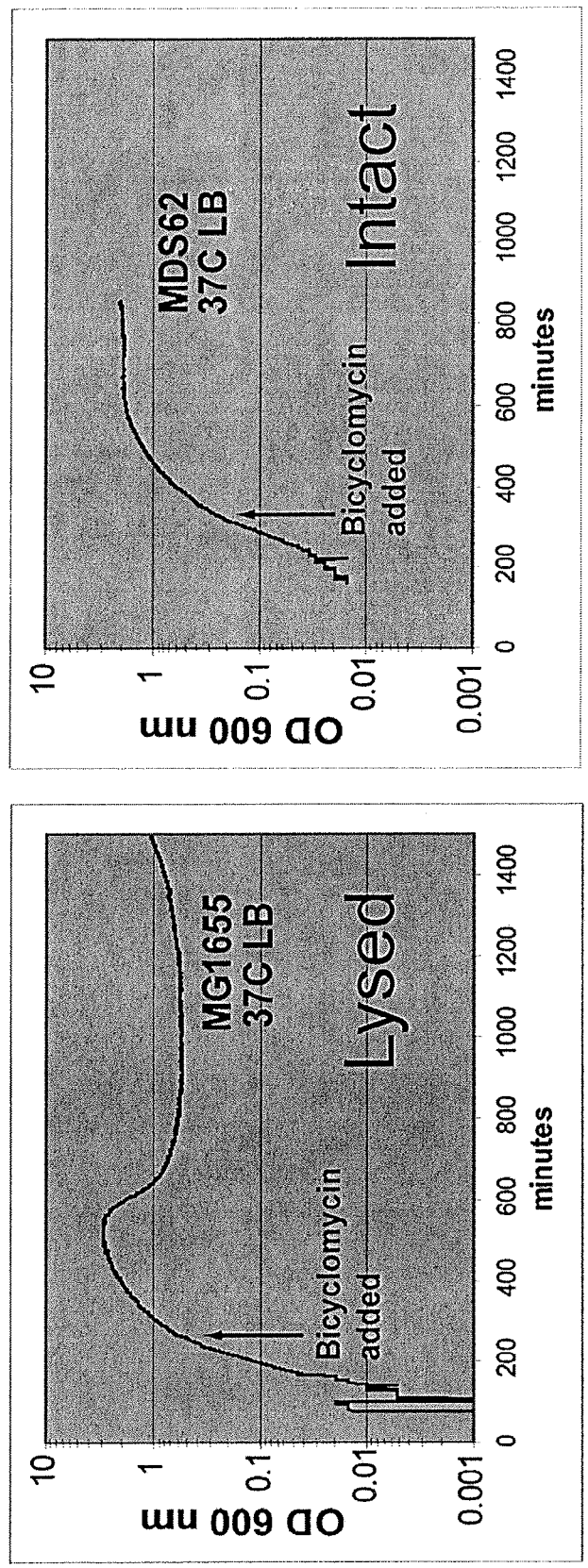
FIG. 7 illustrates the effect of stress-induced prophage reactivation on the growth of MG1655 (native parent strain) and MDS62 (a reduced genome strain lacking all prophage elements).

The effect of stress-induced prophage reactivation on the growth of parent *E. coli* strain MG1655 was tested. Briefly, MG1655 was grown under standard growth conditions to early log phase at which time bicyclomycin (100 µg/ml) was added. The effect of bicyclomycin on growth was then followed. Bicyclomycin is an antibiotic which disrupts the activity of Rho, a transcription termination factor which is essential for viability of gram negative bacteria such as *E. coli*. The *E. coli* genes most repressed by Rho are found within the endogenous prophages; accordingly, bicyclomycin provides a means for testing the effects of derepressing (i.e. activating) prophage elements in *E. coli*. MG1655 continued to grow to an optical density of ~5.0 at 600 nm after which a sharp decline in optical density was observed (FIG. 7, left panel). In a parallel experiment, MDS62, a reduced genome strain comprising a ~20% genome reduction including deletion of all prophage elements (MDS62 deletions are set forth at Tables 1 and 2), was grown under identical conditions and bicyclomycin (100 µg/ml) added at the same optical density after which growth was followed. Strikingly, no decline in optical density was observed following addition of bicyclomycin (FIG. 7, right panel); rather, MDS62 cells exhibited the same growth pattern observed in the absence of bicyclomycin. Thus, deletion of prophage elements confers resistance to bicyclomycin.

Figure 8:
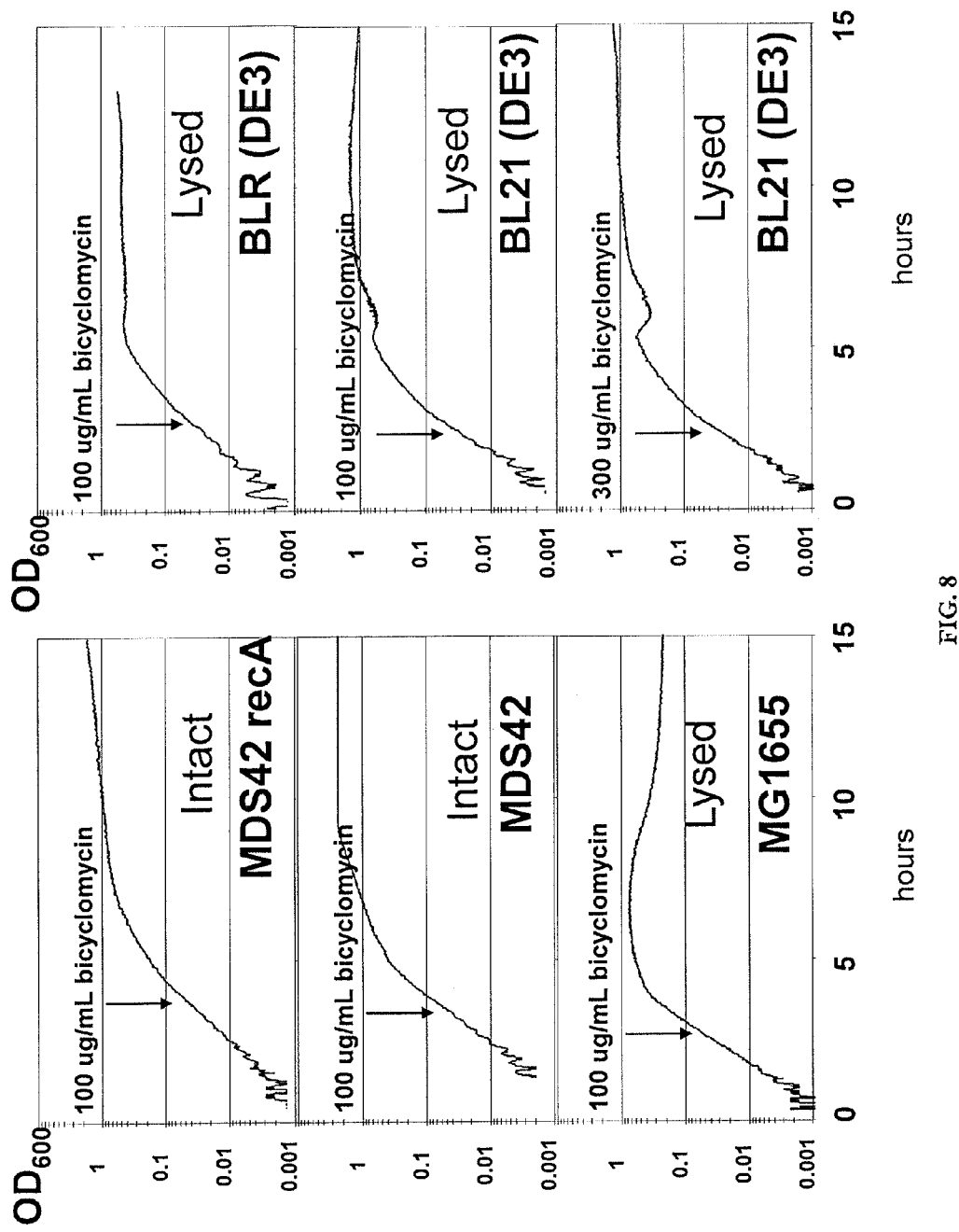
FIG. 8 illustrates microscopic visualization of the effect of stress-induced prophage reactivation on the growth of MG1655, MDS42recA, MDS42, BLR(DE3) and BL21 (DE3).
Figure 9:
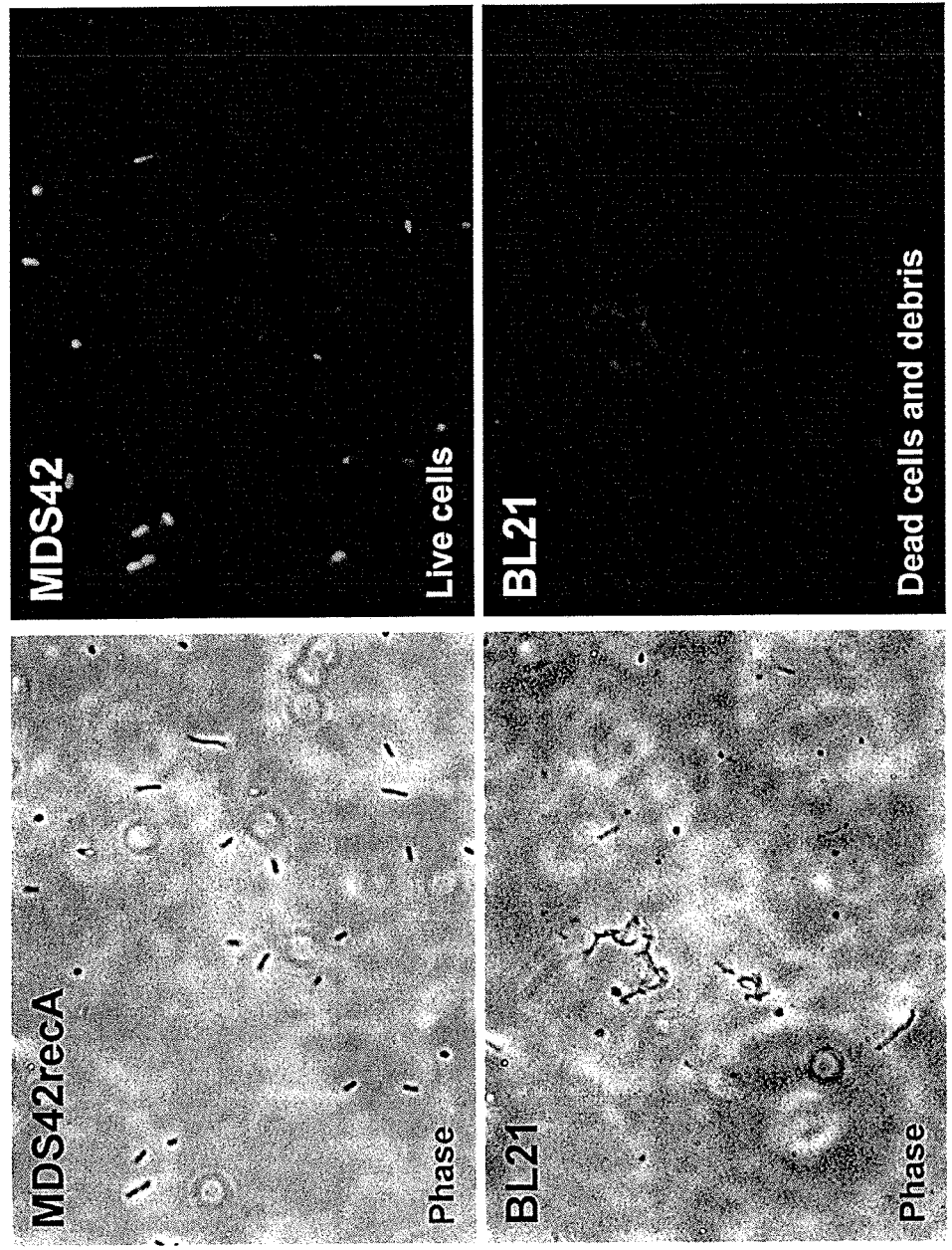
FIG. 9 illustrates the effect of bicyclomycin on viability of MDS42 and BL21(DE3).

The effect of bicyclomycin on growth (standard conditions) of reduced genome strains MDS42 and MDS42recA was also tested and compared to parent strain MG1655. These strains, which also lack all prophage elements also exhibited resistance to bicyclomycin (FIG. 8, left panel); growth was identical to that observed in the absence of bicyclomycin.

Next, the effects of bicyclomycin on growth of an *E. coli* B strain, BL21(DE3), was tested. BL21(DE3) exhibited a sharp decline in optical density following addition of bicylomycin, similar to that observed for MG1655, confirming that both B and K12 strains are sensitive to reactivation of prophage elements.

Morphology of bicyclomycin-induced cultures was then examined. Briefly, samples of MDS42 and BL21 bacteria were collected following addition of bicyclomycin and stained for visualization. Microscopy confirmed that addition of bicyclomycin causes BL21 bacteria to lyse whereas MDS42 bacteria are resistant. Thus, deletion of prophage elements confers resistance of gram negative bacteria such as *E. coli* to bicyclomycin. Reactivation of prophage elements in native parent *E. coli* strains, as exemplified by MG1655 and BL21, causes the cells to lyse, presumably because the gene products of these prophage elements are toxic to the cell. In this respect, lysozyme, a product of prophage elements, destroys the cell wall of certain bacteria (e.g., *E. coli*) and likely contributes to the observed lysis of MG1655 and BL21 cells following addition of bicyclomycin.

Figure 10:
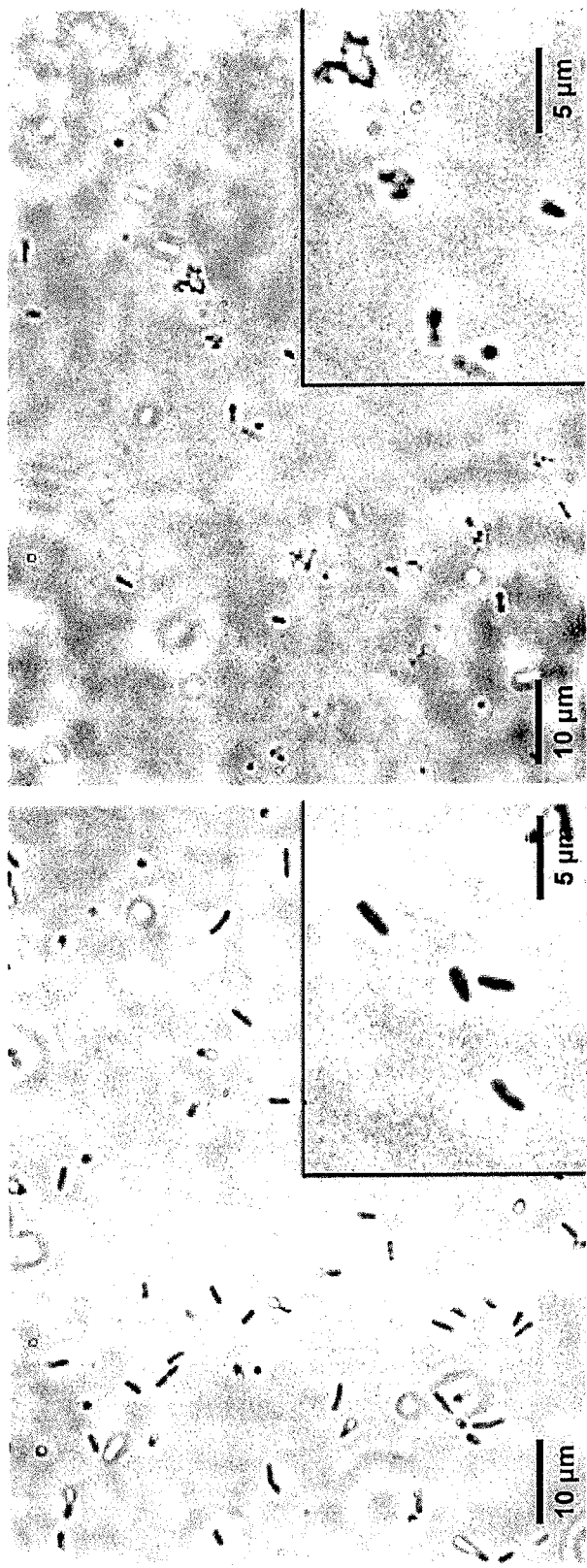
FIG. 10 illustrates the effect of overexpressing gelsolin (a heterologous protein) on viability of MDS42 (left panel) and BL21(DE3) (right panel). MDS42 remains viable even when expressing gelsolin at concentrations greater than 25 g/L whereas BL21 cells lyse when expressing gelsolin at 1.3 g/L.

Expression of gene products at high concentrations, even products whose expression is tolerated at lower concentrations, can activate the stress response in bacteria thereby limiting their usefulness as host cells for the production of biological reagents. The effect of deleting prophage elements on expression of a heterologous protein was tested. MDS42 and BL21 bacteria were transformed with an expression vector for human plasma gelsolin, then grown to high cell densities in fed-batch fermentations on minimal medium. Expression of the heterologous protein product was induced by addition of IPTG. MDS42 bacteria remained viable even when expressing gelsolin at concentrations above 25 g/L (FIG. 10, left panel). BL21 bacteria, on the other hand, lysed even when expressing gelsolin at a concentration of 1.3 g/L (FIG. 10, right panel). Thus, removal of prophage elements was demonstrated to eliminate stress-induced cell lysis thereby enabling a nearly 20-fold increase in production of the heterologous protein. Bacterial strains lacking prophage elements are surprisingly advantageous hosts for production of gene products.

Reduced Genome *E. coli* B Strains

Table 10 shows a precise description of the deletion endpoints of genes that have been or will be deleted from *E. coli* strain BL21(DE3). The right and left sequence of the primers used to make the deletions are listed at Table 11. Seven consecutive genomic deletions have been made thus far, the first of which resulted in strain BL1, the second of which resulted in strain BL2 and so on up to strain BL7. Among the genomic regions deleted to date are all DLP12 and CP4-44 prophage elements. Future BL21(DE3)-derived strains will have all DLP12, λ*B, RybB*B, Rac, Qin, CP-44, SsrA*B, PheV*B, SelC*B and KpLE2 prophage elements deleted therefrom and all insertion sequences deleted therefrom using the methods described herein. DE3, a λ prophage carrying the T7 polymerase gene which renders this strain suitable for production of protein from target genes cloned in T7-driven expression vectors, is not among the planned deletions. The sequence numbering is taken from the published BL21(DE3) sequence (GenBank Accession No. CP001509).

The deletions were made using the Procedures described above. The genomic coordinates of the planned and carried out deletions are: BMD1 15385-24623; BMD2 241256-243669; BMD3 262791-264601; BMD4 352423-357555; BMD5 376748-377531; BMD6 536916-592056; BMD7 619107-638679; BMD8 658152-671312; BMD9 1193606-1194384; BMD10 1322339-1325012; BMD11 1398349-1451586; BMD12 1460130-1460927; BMD13 1857061-1858411; BMD14 1973270-1974687; BMD15 2004159-2011036; BMD16 2031433-2072701; BMD17 2128600-2129378; BMD18 2139556-2143995; BMD19 2262740-2263509; BMD20 2406676-2408561; BMD21 2616656-2618847; BMD22 2677319-2685932; BMD23 2772836-2775877; BMD24 2821970-2834720; BMD25 2996251-3070465; BMD26 3433461-3434239; BMD27 3651091-3662535; BMD28 3736504-3742367; BMD29 3893549-3894996; BMD30 4479765-4586245.

A total of 440,337 base pairs, which is approximately 9.5% of the native BL21(DE3) *E. coli* genome, will be removed, including all prophage elements and all insertions sequences. To date, approximately 145,344 base pairs, which is approximately 3.1% of the native BL21(D3) *E. coli* genome has been removed, including all DLP12 and CP4-44 prophage elements, with no significant effect on bacterial survival or bacterial growth.

TABLE 1

FIRST COMPLETED DELETIONS

| Deletion | Endpoints[a] | Size (bp) | Description[b] |
|---|---|---|---|
| MD1 | 263080, 324632 | 61553 | b0246-b0310; includes K-islands #16, 17, 18, CP4-6, eaeH |
| MD2 | 1398351, 1480278 | 81928 | b1336-b1411; includes K-island #83, Rac |
| MD3 | 2556711, 2563500 | 6790 | b2441-b2450; includes K-island #128, CP-Eut |
| MD4 | 2754180, 2789270 | 35091 | b2622-b2660; includes K-island #137, CP4-57, ileY |
| MD5 | 2064327, 2078613 | 14287 | b1994-b2008; includes K-islands #94, 95, 96, CP4-44 |
| MD6 | 3451565, 3467490 | 15926 | b3323-b3338; includes K-islands #164, 165 |

TABLE 1-continued

FIRST COMPLETED DELETIONS

| Deletion | Endpoints[a] | Size (bp) | Description[b] |
|---|---|---|---|
| MD7 | 2464565, 2474198 | 9634 | b2349-b2363; includes K-island #121 |
| MD8 | 1625542, 1650785 | 25244 | b1539-b1579; includes K-island #77, Qin |
| MD9 | 4494243, 4547279 | 53037 | b4271-b4320; includes K-island #225, fec operon, fim operon |
| MD10 | 3108697, 3134392 | 25696 | b2968-b2987; includes K-island #153, glc operon |
| MD11 | 1196360, 1222299 | 25940 | b1137-b1172; includes K-island #71, e14 |
| MD12 | 564278, 585331 | 21054 | b0538-b0565; includes K-island #37, DLP12 |

TABLE 2

SECOND SET OF COMPLETED DELETIONS

IS186 deletions (3)

| | |
|---|---|
| keep dnaJ | 14168, 15298 (+) |
| *delete GP1 | 15388, 20563 IS186, gef, nhaAR, IS1 |
| [IS186 | 15388, 16730] |
| [IS1 | 19796, 20563] |
| keep rpsT | 20815, 21078 (−) |
| keep pheP | 601182, 602558 (+) |
| *delete GP2 | 602639, 608573 ybdG, nfnB, ubdF, ybdJ, ybdK, IS186 |
| {IS186 | 607231, 608573] |
| keep entD | 608682, 609311 (−) |
| keep glk | 2506481, 2507446 (−) |
| *delete GP3 | 2507650, 2515969 b2389, b2390, b2391, b2392, nupC, IS186, yfeA |
| [IS186 | 2512294, 2513636] |
| keep alaX | 2516061, 2516136 (−) |

IS2 deletions (3 not already deleted)

| | |
|---|---|
| Keep yaiN | 378830, 379126 (−) |
| *delete GP4 | 379293, 387870 yaiO, b0359, IS2, b0362, yaiP, yaiS, tauABCD |
| [IS2 | 380484, 381814] |
| keep hemB | 387977, 388984 (−) |
| *delete GP5 | 389121, 399029 b0370, yaiT, IS3, yaiU, yaiV, ampH, sbmA, yaiw, yaiY, yaiZ |
| [IS3 | 390933, 392190] |
| keep ddlA | 399053, 400147 (−) |
| keep ygeK | 2992482, 2992928 (−) |
| *delete GP6 | 2992959, 2996892 b2856, b2857, b2858, b2859, IS2, b2862, b2863 |
| [IS2 | 2994383, 2995713] |
| keep glyU | 2997006, 2997079 (−) |
| keep ribB | 3181829, 3182482 (−) |
| *delete GP7 | 3182796, 3189712 b3042, ygiL, IS2, yqiGHI (fimbral locus) |
| [IS2 | 3184112, 3185442] |
| keep glgS | 3189755, 3189955 (−) |

IS5 deletions (6 not already deleted)

| | |
|---|---|
| keep ybeJ | 686062, 686970 (−) |
| *delete GP8 | 687074, 688268 IS5 |
| keep Int | 688566, 690104 (−) |
| keep tpx | 1386329, 1386835 (−) |
| *delete GP9 | 1386912, 1396646 ycjG, ycjI, ycjY, ycgZ, mppA, ynaI, IS5, ynaJ, ydaA |
| [IS5 | 1394068, 1395262] |
| keep fnr | 1396798, 1397550 (−) |
| keep gnd | 2097884, 2099290 (−) |
| *delete GP10 | 2099418, 2135739 IS5 plus entire O Antigen and Colanic Acid clusters |
| [IS5 | 2099771, 2100965] |
| keep yegH | 2135858, 2137507 (+) |
| keep proL | 2284231, 2284307 (+) |
| *delete GP11 | 2284410, 2288200 yejO and IS5 |
| [IS5 | 2286939, 2288133] |
| keep narP | 2288520, 2289167 (+) |
| keep gltF | 3358811, 3359575 (+) |
| *delete GP12 | 3359747, 3365277 IS5 plus yhcADEF (K-island) |
| [IS5 | 3363191, 3364385] |
| keep yhcG | 3365462, 3366589 (+) |
| keep arsC | 3647867, 3648292 (+) |
| *delete GP13 | 3648921, 3651343 yhis and IS5 |

TABLE 2-continued

SECOND SET OF COMPLETED DELETIONS

| | |
|---|---|
| (IS5 | 3640666, 3650860] |
| keep slp | 3651558, 3652157 (+) |
| flagella | |
| Region I | |
| keep mviN | 1127062, 1128597 (+) |
| *delete GP14 | 1128637, 1140209 flgAMN flgBCDEFGHIJKL |
| keep rne | 1140405, 1143590 (−) |
| Region II | |
| keep yecT | 1959975, 1960484 (+) |
| *delete GP15 | 1960605, 1977294 flh, che, mot, tap, tar, IS1 |
| keep yecG | 1977777, 1978205 (+) |
| Regions IIIa and IIIb try deleting both in one action | |
| keep sdiA | 1994133, 1994855 (−) |
| *delete Gp16 | 1995085, 2021700 fli, plus amyA, yec and yed ORFS |
| keep rcsA | 2021990, 2022613 (+) |
| hsd region | |
| keep uxuR | 4552145, 4552918 (+) |
| *delete GP17 | 4553059, 4594581 yji ORFS, plus mcrBCD, hsdRMS, mrr, tsr |
| keep mdoB | 4594719, 4596971 (−) |
| Rhs elements | |
| keep ybbP | 519640, 522054 (+) |
| *delete GP18 | 522062, 529348 RhsD element & associated ORFs |
| keep ybbB | 529356, 530450 (−) |
| keep ybfA | 728357, 728563 (+) |
| *delete GP19 | 728616, 738185 RhsC element & associated ORFs |
| keep ybgA | 738224, 738733 (+) |
| keep yncH | 1524964, 1525176 (+) |
| *delete GP20 | 1525914, 1531648 RhsE element & associated ORFs |
| keep nhoA | 1532048, 1532893 (+) |
| keep nikR | 3616219, 361662 (+) |
| *delete GP21 | 3616623, 3623309 RhsB element & associated ORFs # may need to leave something here to separate converging ORFs? |
| keep yhhJ | 3623310, 3624437 (−) |
| keep yibF | 3758974, 3759582 (−) |
| *delete GP22 | 3759620, 3767868 RhsA element & associated ORFs |
| keep yibH | 3767870, 3769006 (−) |
| the rest of the IS elements | |
| keep appA | 1039840, 1041138 (+) |
| *delete GP23 | 1041253, 1049768 yccZYC (EPS), ymcDCBA (EPS?), IS1 |
| [IS1 | 1049001, 1049768] |
| keep cspH | 1050186, 1050398 (−) |
| keep phoH | 1084215, 1085279 (+) |
| *delete GP24 | 1085329, 1096603 ycdSRQPT (hms homologues), IS3, ymdE, ycdU |
| [IS3 | 1093468, 1094725] |
| keep serX | 1096788, 1096875 (−) |
| keep baeR | 2162298, 216302 (+) |
| *delete GP25 | 2163172, 2175230 P2 remnant, IS3, gat operon |
| [IS3 | 2168193, 2169450] |
| keep fbaB | 2175532, 2176656 (−) |
| keep yhhX | 3577399, 3578436 (−) |
| *delete GP26 | 3578769, 3582674 yhhYZ, IS1, yrhAB |
| [IS1 | 3581059, 3581826] |
| keep ggt | 3582712, 3584454 (−) |
| keep cspA | 3717678, 3717890 (+) |
| *delete GP27 | 3718262, 3719704 IS150 |
| [IS150 | 3718262, 3719704] |
| keep glyS | 3719957, 3722026 (−) |

TABLE 3

Transformation Efficiencies for E. coli Strains MDS31, MDS39 and DH10B

|  | DH10B (transformants per microgram DNA) | MDS31 (transformants per microgram DNA) | MDS39 (transformants per microgram DNA) |
|---|---|---|---|
| pBR322 | $2 \times 10^8$ | $2.2 \times 10^8$ | $2.7 \times 10^8$ |
| Methylated BAC | $2 \times 10^6$ | $0.6 \times 10^6$ | $1.2 \times 10^6$ |
| Unmethylated BAC | $1.8 \times 10^6$ | $4.0 \times 10^3$ | $3.0 \times 10^6$ |

TABLE 4

Deleted Periplasmic Protein Genes

| Deletion | Gene, MR b# | MR Gene | MR Gene Product |
|---|---|---|---|
| GP16 | b1920 | fliY | cysteine transport protein (ABC superfamily, peri_bind) |
| GP16 | b1919 | yedO | D-cysteine desulfhydrase, PLP-dependent |
| GP2 | b0578 | nfnB | dihydropteridine reductase, o2-sensitive NAD(P)H reductase |
| GP4 | b0365 | tauA | taurine transport protein (ABC superfamily, peri_bind) |
| GP9 | b1329 | mppA | periplasmic murein tripeptide transport protein; negative regulator of antibacterial resistance |
| MD2 | b1386 | tynA | copper amine oxidase (tyramine oxidase) |
| MD6 | b3338 | chiA | endochitinase, periplasmic |
| MD9 | b4316 | fimC | periplasmic chaperone required for type 1 fimbrae |
| MD9 | b4290 | fecB | KpLE2 phage-like element; citrate dependent Fe(III) transport protein (ABC superfamily, peri_bind) |
| GP7 | b3047 | yqiH | putative periplasmic chaperone |
| MD1 | b0282 | yagP | putative periplasmic regulator |
| GP12 | b3215 | yhcA | putative periplasmic chaperone |

TABLE 5

Transformation Efficiencies for E. coli Strains MG1655, MDS40 and DH10B

|  | DH10B (transformants per microgram) | MG1655 (transformants per microgram) | MDS40 (transformants per microgram) |
|---|---|---|---|
| pUC19 | $1.3 \times 10^8$ | $2.9 \times 10^8$ | $1.3 \times 10^8$ |
| BAC | $8.8 \times 10^6$ | $3 \times 10^6$ | $6.5 \times 10^6$ |

TABLE 6

Transformation Efficiencies for E. coli Strains MG1655, MDS40 and DH10B

|  | DH10B (transformants per microgram) | MG1655 (transformants per microgram) | MDS40 (transformants per microgram) |
|---|---|---|---|
| pUC19 | $4.5 \times 10^5$ | $3.7 \times 10^4$ | $1.6 \times 10^4$ |

TABLE 7

| Media | Strain | Average Doubling time | Std dev | Max OD |
|---|---|---|---|---|
| MOPS Minimal | MG1655 | 120.41 | 0.63 | 0.82 |
| MOPS Minimal | MDS12 | 123.43 | 6.91 | 0.61 |
| MOPS Minimal | MDS39 | 129.57 | 2.30 | 0.62 |
| MOPS Minimal | MDS40 | 128.26 | 5.30 | 0.61 |
| MOPS Minimal | DH10B | No growth | | |
| Rich Defined | MG1655 | 38.38 | 0.25 | 0.83 |
| Rich Defined | MDS12 | 49.05 | 4.05 | 0.84 |
| Rich Defined | MDS39 | 54.38 | 1.05 | 0.85 |
| Rich Defined | MDS40 | 51.19 | 1.77 | 0.86 |
| Rich Defined | DH10B | 45.40 | 2.30 | 0.62 |

TABLE 8

| MDS12 | MDS40 | MDS73 | del | lend | rend |
|---|---|---|---|---|---|
| deleted | deleted | deleted | MD1 | 263080 | 324632 |
| deleted | deleted | deleted | MD2 | 1398351 | 1480278 |
| deleted | deleted | deleted | MD3 | 2556711 | 2563500 |
| deleted | deleted | deleted | MD4 | 2754180 | 2789270 |
| deleted | deleted | deleted | MD5 | 2064327 | 2078613 |
| deleted | deleted | deleted | MD6 | 3451565 | 3467490 |
| deleted | deleted | deleted | MD7 | 2464565 | 2474198 |
| deleted | deleted | deleted | MD8 | 1625542 | 1650785 |
| deleted | deleted | deleted | MD9 | 4494243 | 4547279 |
| deleted | deleted | deleted | MD10 | 3108697 | 3134326 |
| deleted | deleted | deleted | MD11 | 1196360 | 1222299 |
| deleted | deleted | deleted | MD12 | 564278 | 585331 |
|  | deleted | deleted | GP1 | 15388 | 20562 |
|  | deleted | deleted | GP2 | 602688 | 608572 |
|  | deleted | deleted | GP3 | 2507651 | 2515959 |
|  | deleted | deleted | GP4 | 379334 | 387870 |
|  | deleted | deleted | GP5 | 389122 | 399029 |
|  | deleted | deleted | GP6 | 2993014 | 2996890 |
|  | deleted | deleted | GP7 | 3182797 | 3189712 |
|  | deleted | deleted | GP8 | 687083 | 688267 |
|  | deleted | deleted | GP9 | 1386912 | 1396645 |
|  | deleted | deleted | GP10 | 2099418 | 2135738 |
|  | deleted | deleted | GP11 | 2284421 | 2288200 |
|  | deleted | deleted | GP12 | 3359797 | 3365277 |
|  | deleted | deleted | GP13 | 3648921 | 3651342 |
|  | deleted | deleted | GP14 | 1128620 | 1140209 |
|  | deleted | deleted | GP15 | 1960590 | 1977353 |
|  | deleted | deleted | GP16 | 1995135 | 2021700 |
|  | deleted | deleted | GP17 | 4553059 | 4594581 |
|  | deleted | deleted | GP18 | 522062 | 529349 |
|  | deleted | deleted | GP19 | 728588 | 738185 |
|  | deleted | deleted | GP20 | 1525916 | 1531650 |
|  | deleted | deleted | GP21 | 3616623 | 3623310 |
|  | deleted | deleted | GP22 | 3759620 | 3767869 |
|  | deleted | deleted | GP23 | 1041254 | 1049768 |
|  | deleted | deleted | GP24 | 1085330 | 1096545 |
|  | deleted | deleted | GP25 | 2163173 | 2175230 |
|  | deleted | deleted | GP26 | 3578769 | 3582673 |
|  | deleted | deleted | GP27 | 3718263 | 3719704 |
|  | deleted | deleted | MD40 | 167484 | 173447 |
|  |  | deleted | GP28 | 331595 | 376535 |
|  |  | deleted | GP29 | 1588878 | 1599265 |
|  |  | deleted | GP30 | 3794575 | 3805725 |
|  |  | deleted | GP31 | 3886064 | 3904195 |
|  |  | deleted | GP32 | 2599182 | 2612802 |
|  |  | deleted | GP33 | 3738738 | 3752058 |
|  |  | deleted | GP34 | 4055987 | 4073034 |
|  |  | deleted | GP35 | 1349431 | 1364839 |
|  |  | deleted | GP36 | 2876592 | 2885242 |
|  |  | deleted | GP37 | 149715 | 156883 |
|  |  | deleted | GP38 | 674793 | 682616 |
|  |  | deleted | GP39 | 997082 | 1003880 |
|  |  | deleted | GP40 | 2318063 | 2334712 |
|  |  | deleted | gp41 | 3503000 | 3510000 |
|  |  | deleted | gp42 | 4304000 | 4311000 |
|  |  | deleted | gp43 | 557000 | 563000 |
|  |  | deleted | gp44 | 764000 | 770000 |
|  |  | deleted | gp45 | 1555000 | 1561000 |
|  |  | deleted | gp46 | 2382000 | 2388000 |
|  |  | deleted | gp47 | 2447000 | 2453000 |

TABLE 8-continued

| MDS12 | MDS40 | MDS73 | del | lend | rend |
|---|---|---|---|---|---|
| | | deleted | gp48 | 4547600 | 4553000 |
| | | deleted | gp50 | 747000 | 752000 |
| | | deleted | gp51 | 1727000 | 1732000 |
| | | deleted | gp52 | 2859000 | 2864000 |
| | | deleted | gp53 | 4488000 | 4493000 |
| | | deleted | gp54 | 2520000 | 2524000 |
| | | deleted | gp55 | 4086000 | 4090000 |
| | | deleted | gp56 | 1250000 | 1253000 |
| | | deleted | gp57 | 1650000 | 1653000 |
| | | deleted | gp58 | 2186000 | 2189000 |
| | | deleted | gp59 | 2474000 | 2477000 |
| | | deleted | gp60 | 3358000 | 3360000 |
| | | deleted | gp61 | 3864000 | 3866000 |

TABLE 9

Genes (identified by b-number) deleted for each deletion strain

| | |
|---|---|
| MD1: | b0247, b0248, b0249, b0250, b0251, b0252, b0253, b0254, b0255, b0256, b0257, b0258, b0259, b0260, b0261, b0262, b0263, b0264, b0265, b0266, b0267, b0268, b0269, b0270, b0271, b0272, b0273, b0274, b0275, b0276, b0277, b0278, b0279, b0280, b0281, b0282, b0283, b0284, b0285, b0286, b0287, b0288, b0289, b0290, b0291, b0292, b0293, b0294, b0295, b0296, b0297, b0298, b0299, b0300, b0301, b0302, b0303, b0304, b0305, b0306, b0307, b0308, b0309, b0310 |
| MD2: | b1337, b1338, b1339, b1340, b1341, b1342, b1343, b1344, b1345, b1346, b1347, b1348, b1349, b1350, b1351, b1352, b1353, b1354, b1355, b1356, b1357, b1358, b1359, b1360, b1361, b1362, b1363, b1364, b1365, b1366, b1367, b1368, b1369, b1370, b1371, b1372, b1373, b1374, b1375, b1376, b1377, b1378, b1379, b1380, b1381, b1382, b1383, b1384, b1385, b1386, b1387, b1388, b1389, b1390, b1391, b1392, b1393, b1394, b1395, b1396, b1397, b1398, b1399, b1400, b1401, b1402, b1403, b1404, b1405, b1406, b1407, b1408, b1409, b1410, b1411 |
| MD3: | b2442, b2443, b2444, b2445, b2446, b2447, b2448, b2449, b2450 |
| MD4: | b2622, b2623, b2624, b2625, b2626, b2627, b2628, b2629, b2630, b2631, b2632, b2633, b2634, b2635, b2636, b2637, b2638, b2639, b2640, b2641, b2642, b2643, b2644, b2645, b2646, b2647, b2648, b2649, b2650, b2651, b2652, b2653, b2654, b2655, b2656, b2657, b2658, b2659, b2660 |
| MD5: | b1994, b1995, b1996, b1997, b1998, b1999, b2000, b2001, b2002, b2003, b2004, b2005, b2006, b2007, b2008 |
| MD6: | b3323, b3324, b3325, b3326, b3327, b3328, b3329, b3330, b3331, b3332, b3333, b3334, b3335, b3336, b3337, b3338 |
| MD7: | b2349, b2350, b2351, b2352, b2353, b2354, b2355, b2356, b2357, b2358, b2359, b2360, b2361, b2362, b2363 |
| MD8: | b1540, b1541, b1542, b1543, b1544, b1545, b1546, b1547, b1548, b1549, b1550, b1551, b1552, b1553, b1554, b1555, b1556, b1557, b1558, b1559, b1560, b1561, b1562, b1563, b1564, b1565, b1566, b1567, b1568, b1569, b1570, b1571, b1572, b1573, b1574, b1575, b1576, b1577, b1578, b1579 |
| MD9: | b4271, b4272, b4273, b4274, b4275, b4276, b4277, b4278, b4279, b4280, b4281, b4282, b4283, b4284, b4285, b4286, b4287, b4288, b4289, b4290, b4291, b4292, b4293, b4294, b4295, b4296, b4297, b4298, b4299, b4300, b4301, b4302, b4303, b4304, b4305, b4306, b4307, b4308, b4309, b4310, b4311, b4312, b4313, b4314, b4315, b4316, b4317, b4318, b4319, b4320 |
| MD10: | b2969, b2970, b2971, b2972, b2973, b2974, b2975, b2976, b2977, b2978, b2979, b2980, b2981, b2982, b2983, b2984, b2985, b2986, b2987 |
| MD11: | b1138, b1139, b1140, b1141, b1142, b1143, b1144, b1145, b1146, b1147, b1148, b1149, b1150, b1151, b1152, b1153, b1154, b1155, b1156, b1157, b1158, b1159, b1160, b1161, b1162, b1163, b1164, b1165, b1166, b1167, b1168, b1169, b1170, b1171, b1172 |
| MD12: | b0538, b0539, b0540, b0541, b0542, b0543, b0544, b0545, b0546, b0547, b0548, b0549, b0550, b0551, b0552, b0553, b0554, b0555, b0556, b0557, b0558, b0559, b0560, b0561, b0562, b0563, b0564, b0565 |
| GP1: | b0016, b0017, b0018, b0019, b0020, b0021, b0022 |
| GP2: | b0577, b0578, b0579, b0580, b0581, b0582 |
| GP3: | b2389, b2390, b2391, b2392, b2393, b2394, b2395 |
| GP4: | b0358, b0359, b0360, b0361, b0362, b0363, b0364, b0365, b0366, b0367, b0368 |
| GP5: | b0370, b0371, b0372, b0373, b0374, b0375, b0376, b0377, b0378, b0379, b0380 |
| GP6: | b2856, b2857, b2858, b2859, b2860, b2861, b2862, b2863 |
| GP7: | b3042, b3043, b3044, b3045, b3046, b3047, b3048 |
| GP8: | b0656 |
| GP9: | b1325, b1326, b1327, b1328, b1329, b1330, b1331, b1332, b1333 |
| GP10: | b2030, b2031, b2032, b2033, b2034, b2035, b2036, b2037, b2038, b2039, b2040, b2041, b2042, b2043, b2044, b2045, b2046, b2047, b2048, b2049, b2050, b2051, b2052, b2053, b2054, b2055, b2056, b2057, b2058, b2059, b2060, b2061, b2062 |
| GP11: | b2190, b2191, b2192 |
| GP12: | b3215, b3216, b3217, b3218, b3219 |
| GP13: | b3504, b3505 |
| GP14: | b1070, b1071, b1072, b1073, b1074, b1075, b1076, b1077, b1078, b1079, b1080, b1081, b1082, b1083 |
| GP15: | b1878, b1879, b1880, b1881, b1882, b1883, b1884, b1885, b1886, b1887, b1888, b1889, b1890, b1891, b1892, b1893, b1894 |
| GP16: | b1917, b1918, b1919, b1920, b1921, b1922, b1923, b1924, b1925, b1926, b1927, b1928, b1929, b1930, b1931, b1932, b1933, b1934, b1935, b1936, b1937, b1938, b1939, b1940, b1941, b1942, b1943, b1944, b1945, b1946, b1947, b1948, b1949, b1950 |
| GP17: | b4325, b4326, b4327, b4328, b4329, b4330, b4331, b4332, b4333, b4334, b4335, b4336, b4337, b4338, b4339, b4340, b4341, b4342, b4343, b4344, b4345, b4346, b4347, b4348, b4349, b4350, b4351, b4352, b4353, b4354, b4355, b4356, b4357, b4358 |
| GP18: | b0497, b0498, b0499, b0500, b0501, b0502 |
| GP19: | b0700, b0701, b0702, b0703, b0704, b0705, b0706 |
| GP20: | b1456, b1457, b1458, b1459, b1460, b1461, b1462 |
| GP21: | b3482, b3483, b3484 |
| GP22: | b3593, b3594, b3595, b3596 |
| GP23: | b0981, b0982, b0983, b0984, b0985, b0986, b0987, b0988 |
| GP24: | b1021, b1022, b1023, b1024, b1025, b1026, b1027, b1028, b1029, b1030, b1031 |
| GP25: | b2080, b2081, b2082, b2083, b2084, b2085, b2086, b2087, b2088, b2089, b2090, b2091, b2092, b2093, b2094, b2095, b2096 |
| GP26: | b3441, b3442, b3443, b3444, b3445, b3446 |
| GP27: | b3557, b3558 |
| MD40: | b0150, b0151, b0152, b0153 |
| GP28: | b0315, b0316, b0317, b0318, b0319, b0320, b0321, b0322, b0323, b0324, b0325, |

TABLE 9-continued

Genes (identified by b-number) deleted for each deletion strain

|  |  |
|---|---|
|  | b0326, b0327, b0328, b0329, b0330, b0331, b0333, b0334, b0335, b0336, b0337, b0338, b0339, b0340, b0341, b0342, b0343, b0344, b0345, b0346, b0347, b0348, b0349, b0350, b0351, b0352, b0353, b0354 |
| GP29: | b1507, b1508, b1509, b1510, b1511, b1512 |
| GP30: | b3622, b3623, b3624, b3625, b3626, b3627, b3628, b3629, b3630, b3631, b3632 |
| GP31: | b3707, b3708, b3709, b3710, b3711, b3712, b3713, b3714, b3715, b3716, b3717, b3718, b3719, b3720, b3721, b3722, b3723 |
| GP32: | b2481, b2482, b2483, b2484, b2485, b2486, b2487, b2488, b2489, b2490, b2491, b2492 |
| GP33: | b3573, b3574, b3575, b3576, b3577, b3578, b3579, b3580, b3581, b3582, b3583, b3584, b3585, b3586, b3587 |
| GP34: | b3871, b3872, b3873, b3874, b3875, b3876, b3877, b3878, b3879, b3880, b3881, b3882, b3883, b3884 |
| GP35: | b1289, b1290, b1291, b1292, b1293, b1294, b1295, b1296, b1297, b1298, b1299, b1300, b1301, b1302 |
| GP36: | b2754, b2755, b2756, b2757, b2758, b2759, b2760, b2761 |
| GP37: | b0135, b0136, b0137, b0138, b0139, b0140, b0141 |
| GP38: | b0644, b0645, b0646, b0647, b0648, b0649, b0650 |
| GP39: | b0938,, b0939, b0940, b0941, b0942, b0943, b0944, b0945 |
| GP40: | b2219, b2220, b2221, b2222, b2223, b2224, b2225, b2226, b2227, b2228, b2229, b2230 |
| gp41: | b3376, b3377, b3378, b3379, b3380, b3381, b3382, b3383 |
| gp42: | b4084, b4085, b4086, b4087, b4088, b4089, b4090 |
| gp43: | b0530, b0531, b0532, b0533, b0534, b0535 |
| gp44: | b0730, b0731, b0732 |
| gp45: | b1483, b1484, b1485, b1486, b1487 |
| gp46: | b2270, b2271, b2272, b2273, b2274, b2275 |
| gp47: | b2332, b2333, b2334, b2335, b2336, b2337, b2338 |
| gp48: | b4321, b4322, b4323, b4324 |
| gp50: | b0716, b0717, b0718, b0719 |
| gp51: | b1653, b1654, b1655 |
| gp52: | b2735, b2736, b2737, b2738, b2739, b2740 |
| gp53: | b4265, b4266, b4267, b4268, b4269 |
| gp54: | b2405, b2406, b2407, b2408, b2409 |
| gp55: | b3897, b3898, b3899, b3900, b3901 |
| gp56: | b1201 |
| gp57: | b1580, b1581 |
| gp58: | b2108, b2109, b2110, b2111, b2112 |
| gp59: | b2364, b2365 |
| gp60: | b3213, b3214 |
| gp61: | b3686, b3687, b3688, b3689, b3690 |

TABLE 10

Completed Deletions from Parent Strain BL21(DE3)

| Deletion | Endpoints | Size (bp) | strain | notes |
|---|---|---|---|---|
| BMD1 | 15385-24623 | 9238 |  | equivalent to MD13 |
| BMD2 | 241256-243669 | 2413 |  | no MDS equivalent |
| BMD3 | 262791-264601 | 1810 | BL1 | no MDS equivalent |
| BMD4 | 352423-357555 | 5132 |  | approximately equivalent to MD16 |
| BMD5 | 376748-377531 | 783 |  | no MDS equivalent |
| BMD6 | 536916-592056 | 55140 | BL7 | approximately equivalent to MD12, MD61 and MD14 (DLP12 prophage+) |
| BMD7 | 619107-638679 | 19572 |  | includes MD57 |
| BMD8 | 658152-671312 | 13160 |  | includes MD47 |
| BMD9 | 1193606-1194384 | 778 |  | Precise deletion restore nagK and removes IS1 |
| BMD10 | 1322339-1325012 | 2673 |  | no MDS equivalent |
| BMD11 | 1398349-1451586 | 53237 |  | equivalent to MD2 includes rac prophage |
| BMD12 | 1460130-1460927 | 797 |  | Precise deletion restores cybB and removes IS1 |
| BMD13 | 1857061-1858411 | 1350 |  | Precise deletion restores yeaR and removes IS186 |
| BMD14 | 1973270-1974687 | 1417 | BL4 | No MDS equivalent |
| BMD15 | 2004159-2011036 | 6877 | BL2 | includes MD5 CP4-44 prophage |
| BMD16 | 2031433-2072701 | 41268 |  | includes MD22 colanic acid cluster |
| BMD17 | 2128600-2129378 | 778 |  | Precise deletion restores gatZ removes IS1 |
| BMD18 | 2139556-2143995 | 4439 | BL3 | No MDS equivalent |
| BMD19 | 2262740-2263509 | 769 |  | No MDS equivalent |
| BMD20 | 2406676-2408561 | 1885 |  | No MDS equivalent |
| BMD21 | 2616656-2618847 | 2191 |  | No MDS equivalent |
| BMD22 | 2677319-2685932 | 8613 |  | approximately equivalent to MD4, includes CP4-57 prophage |
| BMD23 | 2772836-2775877 | 3041 |  | No MDS equivalent |
| BMD24 | 2821970-2834720 | 12750 |  | No MDS equivalent - remove fuc operon |
| BMD25 | 2996251-3070465 | 74214 | BL5 | Similar to MD10 includes CP4-44 prophage |
| BMD26 | 3433461-3434239 | 778 |  | Precise deletion restores yhfS |
| BMD27 | 3651091-3662535 | 1444 |  | equivalent to MD39 |
| BMD28 | 3736504-3742367 | 5863 |  | removes IS1 in rfa gene cluster |
| BMD29 | 3893549-3894996 | 1447 | BL6 | no MDS equivalent |
| BMD30 | 4479765-4586245 | 106480 |  | approximately equivalent to MD9 and MD29 includes KplE2 prophage element |

TABLE 11

| Strain | lsequence | rsequence | Strain | lsequence | rsequence |
|---|---|---|---|---|---|
| BMD1 | Gaaaagtggcggggatcact (SEQ ID NO: 2) | Tacctcaatgtgtatcacaa (SEQ ID NO: 3) | BMD16 | Cattttatatgaaattactgaa (SEQ ID NO: 32) | Gtcattttacccgatagccg (SEQ ID NO: 33) |
| BMD2 | Gccatttttaatatagattg (SEQ ID NO: 4) | Gttctgctgatttaaccgca (SEQ ID NO: 5) | BMD17 | Tcaacatcatcgtttcgacg (SEQ ID NO: 34) | Ctatttttaatccgactatg (SEQ ID NO: 35) |
| BMD3 | Ggtcatgccaaccgcgacaa (SEQ ID NO: 6) | Ctgatttttaattaacgcgcg (SEQ ID NO: 7) | BMD18 | Gcagaagggcaccccgagtc (SEQ ID NO: 36) | Tgaacgttatccctgtagta (SEQ ID NO: 37) |
| BMD4 | Atagcgggcggcagaaggaa (SEQ ID NO: 8) | Tacgagagtggacggtcccc (SEQ ID NO: 9) | BMD19 | Gagaaatagtgcaggccgtc (SEQ ID NO: 38) | Gtccggcagataaagactaa (SEQ ID NO: 39) |
| BMD5 | Tccggcattaaaggaaaat (SEQ ID NO: 10)C | Ttaacgttgtgcttcgcca (SEQ ID NO: 11) | BMD20 | Aatcaacatggaataaaatc (SEQ ID NO: 40) | Tagtcagtgacgaacatcag (SEQ ID NO: 41) |
| BMD6 | Atcctgcagggcgcgccatt (SEQ ID NO: 12) | Ggagtaatccccgcatatcc (SEQ ID NO: 13) | BMD21 | Aagcgcggggagagttgcgt (SEQ ID NO: 42) | Tccgtcgaggattgcgcttt (SEQ ID NO: 43) |
| BMD7 | Acgcagattttttgcccat (SEQ ID NO: 14) | Atatgcccaataaattgtcg (SEQ ID NO: 15) | BMD22 | Caagctctgcgggcttttt (SEQ ID NO: 44) | Cctttgaaaacaggacgtaa (SEQ ID NO: 45) |
| BMD8 | Ccccggcccttgtttttatc (SEQ ID NO: 16) | Atatgcccaataaattgtcg (SEQ ID NO: 17) | BMD23 | Cgctggcgcggggaacaccc (SEQ ID NO: 46) | Caggttgatagaaatatcgc (SEQ ID NO: 47) |
| BMD9 | Gttggcggcgggctgatttt (SEQ ID NO: 18) | caacggcaaaccgattaccg (SEQ ID NO: 19) | BMD24 | Ctccttgttgctttacgaaa (SEQ ID NO: 48) | Cggaaagggtagcaggccgg (SEQ ID NO: 49) |
| BMD10 | Cgttccatggatggaagact (SEQ ID NO: 20) | Ttaagctgatgttaatcgaa (SEQ ID NO: 21) | BMD25 | Ttgcgggtatacctcagttc (SEQ ID NO: 50) | Agattacgccatttttgaatt (SEQ ID NO: 51) |
| BMD11 | Gcaacatcagcagccatacc (SEQ ID NO: 22) | Ttatgcagcaacaatgctgt (SEQ ID NO: 23) | BMD26 | Gcgcgcaacgttgccagcac (SEQ ID NO: 52) | Atctgccagcacgtagctgt (SEQ ID NO: 53) |
| BMD12 | Tcacagtgaaacgtaacgta (SEQ ID NO: 24) | Tactgaaaacgggtgaacaa (SEQ ID NO: 25) | BMD27 | Gtgttgatttccaacgagta (SEQ ID NO: 54) | Aactttgatttatagtcagg (SEQ ID NO: 55) |
| BMD13 | Ataacggaaaggcgtgggta (SEQ ID NO: 26) | Aaccccgggcgcgttcctt (SEQ ID NO: 27) | BMD28 | Aaaacgctgctatgatttaa (SEQ ID NO: 56) | Aaaattcttatcgataccgt (SEQ ID NO: 57) |
| BMD14 | Acgatgcctcaccgacgact (SEQ ID NO: 28) | Tccctgttacgttttaatgt (SEQ ID NO: 29) | BMD29 | Ctcaggtcgaaatctaacgc (SEQ ID NO: 58) | Cagacgcctcctttcttcat (SEQ ID NO: 59) |
| BMD15 | Tggtggcgactatgcactag (SEQ ID NO: 30) | Gcagaaactccgtaatgaag (SEQ ID NO: 31) | BMD30 | Tttttttatgcctgaaatcc (SEQ ID NO: 60) | Taaggcgagattattaaagt (SEQ ID NO: 61) |

REFERENCES

The following references, to the extent that they provide exemplary procedural or other details supplementary to those set forth herein, are specifically incorporated herein by reference:

U.S. Pat. No. 5,578,464
U.S. Pat. No. 5,747,662
U.S. Pat. No. 6,022,952
U.S. Pat. No. 6,335,178
U.S. Pat. No. 6,372,476
U.S. Pat. No. 6,472,16
Blattner et al., *Science*, 277:1453-1474, 1997.
*Current Protocols in Molec. Biol.*, 16.6.1-16.6.14, 1994.
Danese et al., *Annu. Rev. Genet.*, 32:59-94, 1998.
Datsenko et al., *Proc. Natl. Acad. Sci. USA*, 97:6640-6649, 2000.
Fekes et al., *Microbiol. Mol. Biol. Rev.*, 63:161-193, 1999.
Hanahan, *J. Mol. Biol.*, 166(4):557-580, 1983.
Hannig et al., *Trends Biotechnol.*, 16(2):54-60, 1998.
Hayashi et al., *DNA Res.*, 8:11-22, 2001.
Hockney, *Trends Biotechnol.*, 12(11): 456-632, 1994.
Hynds et al., *J. Biol. Chem.*, 273:34868-34874, 1998.
Muyrers et al., *Nucl. Acids Res.*, 27:1555-1557, 1999.
Neidhardt et al., *J. Bacteriol.*, 119(3):736-747, 1974.
Perna et al, *Nature*, 409:529-533, 2001.
Posfai et al., *J. Bacteriol.*, 179:4426-4428, 1997.
Posfai et al., *Nucl. Acids Res.*, 27:4409-4415, 1999.
Pugsley, *Microbiol. Rev.*, 57:50-108, 1993.
Sambrook et al., In: *Molecular Cloning. A Laboratory Manual*, Cold Spring Harbor Laboratory Press, Cold Spring Harbor, N.Y., 1989.
Santini et al., *EMBO J.*, 17:101-112, 1998.
Sargent et al., *EMBO J.*, 17(13):3640-3650, 1998.
Thomas et al., *Mol-Micro.*, 39(1):47-53, 2001.
Venkatesan et al., *Infection Immunity*, 3271-3285, 2001.
Weiner et al., *Cell*, 93:93-101, 1998.
Welch et al., *Proc. Natl. Acad. Sci. USA*, 99:26:17020-17024, 2002.

SEQUENCE LISTING (61 sequences)

SEQ ID NO: 1 - DNA, 4639675 bp, Escherichia coli (residues 1-1,546,559 of 4,639,675)
agcttttcattctgactgcaacgggcaatatgtctctgtgtggattaaaaaaagagtgtctgatagcagcttctgaactggttacctgccgtgagtaaattaaaattttattgacttaggtcactaaatactttaaccaatataggcatagcgcacagacagataaaaattacagagtacacaacatccatgaaacgcattagcaccaccattaccaccaccatcaccattaccacaggtaacggtgcgggctgacgcgtacaggaaacacagaaaaaagcccgcacctgacagtgcgggctttttttttcgaccaaaggtaacgaggtaacaaccatgcgagtgttgaagttcggcggtacatcagtggcaaatgcagaacgttttctgcgtgttgccgatattctggaaagcaatgccaggcaggggcaggtggccaccgtcctctctgcccccgccaaaatcaccaaccacctggtggcgatgattgaaaaaaccattagcggccaggatgctttacccaatatcagcgatgccgaacgtatttttgccgaacttttgacgggactcgccgccgcccagccggggttcccgctggcgcaattgaaaactttcgtcgatcaggaatttgcccaaataaaacatgtcctgcatggcattagtttgttggggcagtgcccggatagcatcaacgctgcgctgatttgccgtggcgagaaaatgtcgatcgccattatggccggcgtattagaagcgcgcggtcacaacgttactgttatcgatccggtcgaaaaactgctggcagtggggcattacctcgaatctaccgtcgatattgctgagtccacccgccgtattgcggcaagccgcattccggctgatcacatggtgctgatggcaggtttcaccgccggtaatgaaaaaggcgaactggtggtgcttggacgcaacggttccgactactctgctgcggtgctggctgcctgtttacgcgccgattgttgcgagatttggacggacgttgacggggtctatacctgcgacccgcgtcaggtgcccgatgcgaggttgttgaagtcgatgtcctaccaggaagcgatggagctttcctacttcggcgctaaagttcttcacccccgcaccattacccccatcgcccagttccagatcccttgcctgattaaaaataccggaaatcctcaagcaccaggtacgctcattggtgccagccgtgatgaagacgaattaccggtcaagggcatttccaatctgaataacatggcaatgttcagcgtttctggtccggggatgaaagggatggtcggcatggcggcgcgcgtctttgcagcgatgtcacgcgcccgtatttccgtggtgctgattacgcaatcatcttccgaatacagcatcagtttctgcgttccacaaagcgactgtgtgcgagctgaacgggcaatgcaggaagagttctacctggaactgaaagaaggcttactggagccgctggcagtgacggaacggctggccattatctcggtggtaggtgatggtatgcgcaccttgcgtgggatctcggcgaaattctttgccgcactggcccgcgccaatatcaacattgtcgccattgctcagggatcttctgaacgctcaatctctgtcgtggtaaataacgatgatgcgaccactggcgtgcgcgttactcatcagatgctgttcaataccgatcaggttatcgaagtgtttgtgattggcgtcggtggcgttggcggtgcgctgctggagcaactgaagcgtcagcaaagctggctgaagaataaacatatcgacttacgtgtctgcggtgttgccaactcgaaggctctgctcaccaatgtacatggccttaatctggaaaactggcaggaagaactggcgcaagccaaagagccgtttaatctcgggcgcttaattcgcctcgtgaaagaatatcatctgctgaacccggtcattgttgactgcacttccagccaggcagtggcggatcaatatgccgacttcctgcgcgaaggtttccacgttgtcacgccgaacaaaaaggccaacacctcgtcgatggattactaccatcagttgcgttatgcggcggaaaaatcgcggcgtaaattcctctatgacaccaacgttggggctggattaccggttattgagaacctgcaaaatctgctcaatgcaggtgatgaattgatgaagttctccggcattctttctggttcgctttcttatatcttcggcaagttagacgaaggcatgagtttctccgaggcgaccacgctggcgcgggaaatgggttataccgaaccggacccgcgagatgatctttctggtatggatgtggcgcgtaaactattgattctcgctcgtgaaacgggacgtgaactggagctggcggatattgaaattgaacctgtgctgcccgcagagtttaacgccgagggtgatgttgccgcttttatggcgaatctgtcacaactcgacgatctctttgccgcgcgcgtggcgaaggcccgtgatgaaggaaaagttttgcgctatgttggcaatattgatgaagatggcgtctgccgcgtgaagattgccgaagtggatggtaatgatccgctgttcaaagtgaaaaatggcgaaaacgccctggccttctatagccactattatcagccgctgccgttggtactgcgcggatatggtgcgggcaatgacgttacagctgccggtgtctttgctgatctgctacgtaccctctcatggaagttaggagtctgacatggttaaagtttatgccccggcttccagtgccaatatgagcgtcgggtttgatgtgctcggggcggcggtgacacctgttgatggtgcattgctcggagatgtagtcacggttgaggcggcagagacattcagtctcaacaacctcggacgctttgccgataagctgccgtcagaaccacgggaaaatatcgtttatcagtgctgggagcgtttttgccaggaactgggtaagcaaattccagtggcgatgaccctggaaaagaatatgccgatcggttcgggcttaggctccagtgcctgttcggtggtcgcggcgctgatggcgatgaatgaacactgcggcaagccgcttaatgacactcgtttgctggctttgatgggcgagctggaaggccgtatctccggcagcattcattacgacaacgtggcaccgtgttttctcggtggtatgcagttgatgatcgaagaaaacgacatcatcagccagcaagtgccagggtttgatgagtggctgtgggtgctggcgtatccggggattaaagtctcgacggcagaagccagggctattttaccggcgcagtatcgccgccaggattgcattgcgcacgggcgacatctggcaggcttcattcacgcctgctattcccgtcagcctgagcttgccgcgaagctgatgaaagatgttatcgctgaaccctaccgtgaacggttactgccaggcttccggcaggcgcggcaggcggtcgcggaaatcggcgcggtagcgagcggtatctccggctccggcccgaccttgttcgctctgtgtgacaagccggaaaccgcccagcgcgttgccgactggttgggtaagaactacctgcaaaatcaggaaggttttgttcatatttgccggctggatacggcgggcgcacgagtactggaaaactaaatgaaactctacaatctgaaagatcacaacgagcaggtcagctttgcgcaagccgtaacccaggggttgggcaaaaatcaggggctgttttttccgcacgacctgccggaattcagcctgactgaaattgatgagatgctgaagctggattttgtcacccgcagtgcgaagatcctctcggcgtttattggtgatgaaatcccacaggaaatcctggaagagcgcgtgcgcgcggcgtttgccttcccggctccggtcgccaatgttgaaagcgatgtcggttgtctggaattgttccacgggccaacgctggcatttaaagatttcggcggtcgctttatggcacaaatgctgacccatattgcgggtgataagccagtgaccattctgaccgcgacctccggtgataccggagcggcagtggctcatgctttctacggtttaccgaatgtgaaagtggttatcctctatccacgaggcaaaatcagtccactgcaagaaaaactgttctgtacattgggcggcaatatcgaaactgttgccatcgacggcgatttcgatgcctgtcaggcgctggtgaagcaggcgtttgatgatgaagaactgaaagtggcgctagggttaaactcggctaactcgattaacatcagccgtttgctggcgcagatttgctactactttgaagctgttgcgcagctgccgcaggagacgcgcaaccagctggttgtctcggtgccaagcggaaacttcggcgatttgacggcgggtctgctggcgaagtcactcggtctgccggtgaaacgttttattgctgcgaccaacgtgaacgataccgtgccacgtttcctgcacgacggtcagtggtcacccaaagcgactcaggcgacgttatccaacgcgatggacgtgagtcagccgaacaactggccgcgtgtggaagagttgttccgccgcaaaatctggcaactgaaagagctgggttatgcagccgtggatgatgaaaccacgcaacagacaatgcgtgagttaaaagaactgggctacacttcggagccgcacgctgccgtagcttatcgtgcgctgcgtgatcagttgaatccaggcgaatatggcttgttcctcggcaccgcgcatccggcgaaatttaaagagagcgtggaagcgattctcggtgaaacgttggatctgccaaaagagctggcagaacgtgctgatttacccttgctttcacataatctgcccgccgattttgctgcgttgcgtaaattgatgatgaatcatcagtaaaatctattcattatctcaatcaggccgggtttgcttttatgcagcccggcttttttatgaagaaattatggagaaaaatgacagggaaaaaggagaaattctcaataaatgcggtaacttagagattaggattgcggagaataacaaccgccgttctcatcgagtaatctccggatatcgacccataacgggcaatgataaaaggagtaacctgtgaaaaagatgcaatctatcgtactcgcactttccctggttctggtcgctcccatggcagcacaggctgcggaaattacgttagtcccgtcagtaaaattacagataggcgatcgtgataatcgtggctattactgggatggaggtcactggcgcgaccacggctggtggaaacaacattatgaatggcgaggcaatcgctggcacctacacggaccgccgccaccgccgcgccaccataagaaagctcctcatgatcatcacggcggtcatggtccaggcaaacatcaccgctaaatgacaaatgccgggtaacaatccggcattcagcgcctgatgcgacgctggcgcgtcttatcaggcctacgttaattctgcaatatattgaatctgcatgcttttgtaggcaggataaggcgttcacgccgcatccggcattgactgcaaacttaacgctgctcgtagcgtttaaacaccagttcgccattgctggaggaatcttcatcaaagaagtaaccttcgctattaaaaccagtcagttgctctggtttggtcagccgattttcaataatgaaacgactcatcagaccgcgtgctttcttagcgtagaagctgatgatcttaaatttgccgttcttctcatcgaggaacaccggcttgataatctcggcattcaatttcttcggcttcaccgatttaaaatactcatctgacgccagattaatcaccacattatcgccttgtgctgcgagcgcctcgttcagcttgttggtgatgatatctccccagaattgatacagatctttccctcgggcattctcaagacggatccccatttccagacgataaggctgcattaaatcgagcgggcggagtacgccatacaagccggaaagcattcgcaaatgctgttgggcaaaatcgaaatcgtcttcgctgaaggtttcggcctgcaagccggtgtagacatcacctttaaacgccagaatcgcctggcgggcattcgccggcgtgaaatctggctgccagtcatgaaagcgagcggcgttgatacccgccagtttgtcgctgatgcgcatcagcgtgctaatctgcggaggcgtcagtttccgcgcctcatggatcaactgctgggaattgtctaacagctccggcagcgtatagcgcgtggtggtcaacgggctttggtaatcaagcgttttcgcaggtgaaataagaatcagcatatccagtccttgcaggaaatttatgccgactttagcaaaaaatgagaatgagttgatcgatagttgtgattactcctgcgaaacatcatcccacgcgtccggagaaagctggcgaccgatatccggataacgcaatggatcaaacaccgggcgcacgccgagtttacgctggcgtagataatcactggcaatggtatgaaccacaggcgagagcagtaaaatggcggtcaaattggtaatagccatgcaggccattatgatatctgccagttgccacatcagcggaaggcttagcaaggtgccgccgatgaccgttgcgaaggtgcagatccgcaaacaccagatcgctttagggttgttcaggcgtaaaaagaagagattgttttcggcataaatgtagttggcaacgatggagctgaaggcaaacagaataaccacaagggtaacaaactcagcaccccaggaacccattagcacccgcatcgccttctggataagctgaataccttccagcggcatgtaggttgtgccgttacccgccagtaatatcagcatggcgcttgccgtacagatgaccagggtgtcgataaaaatgccaatcatctggacaatcccttgcgctgccggatgcggaggccaggacgccgctgccgctgccgcgtttggcgtcgaacccattcccgcctcattggaaaacatactgcgctgaaaaccgttagtaatcgcctggcttaaggtatatcccgccgcgccgcctgccgcttcctgccagccaaaagcactctcaaaaatagaccaaatgacgtggggaagttgcccgatattcattacgcaaattaccaggctggtcagtacccagattatcgccatcaacgggacaaagccctgcatgagccgggcgacgccatgaagaccgcgagtgattgccagcagagtaaagacagcgagaataatgcctgtcaccagcgggggaaaatcaaaagaaaaactcagggcgcgggcaacggcgttcgcttgaactccgctgaaaattatgccataggcgatgagcaaaaagacggcgaacagaacgcccatccagcgcatccccagcccgcgcgccatataccatgccggtccgccacgaaactgcccattgacgtcacgttctttataaagttgtgccagagaacattcggcaaacgaggtcgccatgccgataaacgcggcaacccacatccaaaagacggctccaggtccaccggcggtaatagccagcgcaacgccggccaggttgccgctacccacgcgcgccgcaagactggtacacaatgactgaaatgaggttaaaccgcctggctgtggatgaatgctatttttaagacttttgccaaactggcggatgtagcgaaactgcacaaatccggtgcgaaaagtgaaccaacaacctgcgccgaagagcaggtaaatcattaccgatccccaaaggacgctgttaatgaaggagaaaaaatctggcatgcatatccctcttattgccggtcgcgatgactttcctgtgtaaacgttaccaattgtttaagaagtatatacgctacgaggtacttgataacttctgcgtagcatacatgaggttttgtataaaaatggcgggcgatatcaacgcagtgtcagaaatccgaaacagtctcgcctggcgataaccgtcttgtcggcggttgcgctgacgttgcgtcgtgatatcatcagggcagaccggttacatccccctaacaagctgtttaaagagaaatactatcatgacggacaaattgacctcccttcgtcagtacaccaccgtagtggccgacactggggacatcgcggcaatgaagctgtatcaaccgcaggatgccacaaccaacccttctctcattcttaacgcagcgcagattccggaataccgtaagttgattgatgatgctgtcgcctgggcgaaacagcagagcaacgatcgcgcgcagcagatcgtggacgcgaccgacaaactggcagtaaatattggtctggaaatcctgaaactggttccgggccgtatctcaactgaagttgatgcgcgtctttcctatgacaccgaagcgtcaattgcgaaagcaaaacgcctgatcaaactctacaacgatgctggtattagcaacgatcgtattctgatcaaactggcttctacctggcagggtatccgtgctgcagaacagctggaaaaagaaggcatcaactgtaacctgaccctgctgttctccttcgctcaggctcgtgcttgtgcggaagcgggcgtgttcctgatctcgccgtttgttggccgtattcttgactggtacaaagcgaataccgataagaaagagtacgctccggcagaagatccgggcgtggtttctgtatctgaaatctaccagtactacaaagagcacggttatgaaaccgtggttatgggcgcaagcttccgtaacatcggcgaaattctggaactggcaggctgcgaccgtctgaccatcgcaccggcactgctgaaagagctggcggagagcgaaggggctatcgaacgtaaactgtcttacaccggcgaagtgaaagcgcgtccggcgcgtatcactgagtccgagttcctgtggcagcacaaccaggatccaatggcagtagataaactggcggaaggtatccgtaagtttgctattgaccaggaaaaactggaaaaaatgatcggcgatctgctgtaatcattcttagcgtgaccgggaagtcggtcacgctacctcttctgaagcctgtctgtcactcccttcgcagtgtatcattctgtttaacgagactgtttaaacggaaaaatcttgatgaatactttacgtattggcttagtttccatctctgatcgcgcatccagcggcgtttatcaggataaaggcatccctgcgctggaagaatggctgacatcggcgctaaccacgccgtttgaactggaaacccgcttaatccccgatgagcaggcgatcatcgagcaaacgttgtgtgagctggtggatgaaatgagttgccatctggtgctcaccacgggcggaactggcccggcgcgtcgtgacgtaacgcccgatgcgacgctggcagtagcggaccgcgagatgcctggctttggtgaacagatgcgccagatcagcctgcattttgtaccaactgcgatcctttcgcgtcaggtgggcgtgattcgcaaacaggcgctgatccttaacttacccggtcagccgaagtctattaaagagacgctggaaggtgtgaaggacgctgagggtaacgttgtggtacacggtatttttgccagcgtaccgtactgcattcagttgctggaagggccatacgttgaaacggcaccggaagtggttgcagcattcagaccgaagagtgcaagacgcgacgttagcgaataaaaaaatccccccgagcggggggatctcaaaacaattagtgggattcaccaatcggcagaacggtgcgaccaaactgctcgttcagtacttcacccatcgccagatagattgcgctggcaccgcagatcagcccaatccagccggcaaagtggatgattgcggcgttaccggcaatgttaccgatcgccagcagggcaaacagcacggtcaggctaaagaaaacgaattgcagaacgcgtgcgcctttcagcgtgccgaagaacataaacagcgtaaatacgccccacagacccaggtagacaccaaggaactgtgcatttggcgcatcggtcagacccagtttcggcatcagcagaatcgcaaccagcgtcagccagaaagaaccgtaagaggtgaatgcggttaaaccgaaagtgttgccttttttgtactccagcagaccagcaaaaatttgcgcgatgccgccgtagaaaatgcccatggcaagaataataccgtccagagcgaaataacccacgttgtgcaggttaagcagaatggtggtcatgccgaagcccatcaggcccagcggtgccggattagccaacttagtgttgcccataattcctcaaaaatcatcatcgaatgaatggtgaaataatttccctgaataactgtagtgttttcagggcgcggcataataatcagccagtggggcagtgtctacgatcttttgaggggaaaatgaaaattttccccggtttccggtatcagacctgagtggcgctaaccatccggcgcaggcaggcgatttgcagtacggctggaatcgtcacgcgataggcgctgccgctgaccgctttaaccccatttagtgccgcacctacagggcctcccagccccgcgccgcgcagcaaaccatgcccaagtacgctcattgctgcgtgggtgcgtaaaatgcgggtcagttggctggaaagcaaatgcgacacaccttttgccaataatttgtctttcatcagcagcggcagcagctcttccagctcattcaccctggcatcgaccgcgtgcagaaactcctgcttatgttcctcgtccattttcttccaggtattacgcagaaattgttccagtaactgttgctcaatttcaaacgtagacatctctttgtcggctttcagcttcaatcgctttgaaacatcgagcaaaatggcccgatacaatttaccgtgtccgcgcagtttgttggcgatactatcgccaccaaaatgctgtaattctccggcaatcagctgccagttgcggcgatgttgctcgggatgcccttccatcgatttaaacagttcgttgcgcatcagtacgctggagaggcgagttttgcctttttcattatgggtgagcaatcgggcgaaatttgccaactgttcctcactacaatgctgaagaaaatccagatctgaatcattcaggtaattaacattcattttttgtggcttctatattctggcgttagtcgtcgccgataattttcagcgtggccatatccgatgagttcaccgtatgacccgaaaaggtgatttttgagacgcagcgtttattgtcgttatcgctgttaatgttgatccagtcagtggtttgcccttcttttatttctgaaggaatattcaggctctgactggcgctacgggcggctttgaaataaaccgatgcaccgcttaactgtaaatcgccatggtcggcagagagttgtatgcgtttcacaatgcgacaaacaggaagtttcagcgccagatcgttggtttcgttacgcggcattgcaatggcgccgaggagtttatggtcgtttgcctgcgccgtgcagcacagcatcaggctaatcgccaggctggcggaaatcgtaaaaacggatttcataaggattctcttagtgggaagaggtagggggatgaatacccactagtttactgctgataaagagaagattcaggcacgtaatcttttctttttattacaattttttgatgaatgccttggctgcgattcattctttatatgaataaaattgctgtcaattttacgtcttgtcctgccatatcgcgaaatttctgcgcaaaagcacaaaaaatttttgcatctcccccttgatgacgtggtttacgaccccatttagtagtcaaccgcagtgagtgagtctgcaaaaaaatgaaattgggcagttgaaaccagacgtttcgcccctattacagactcacaaccacatgatgaccgaatatatagtggagacgtttagatgggtaaaataattggtatcgacctgggtactaccaactcttgtgtagcgattatggatggcaccactcctcgcgtgctggagaacgccgaaggcgatcgcaccacgccttctatcattgcctatacccaggatggtgaaactctagttggtcagccggctaaacgtcaggcagtgacgaacccgcaaaacactctgtttgcgattaaacgcctgattggtcgccgcttccaggacgaagaagtacagcgtgatgtttccatcatgccgttcaaaattattgctgctgataacggcgacgcatgggtcgaagttaaaggccagaaaatggcaccgccgcagatttctgctgaagtgctgaaaaaaatgaagaaaaccgctgaagattacctgggtgaaccggtaactgaagctgttatcaccgtaccggcatactttaacgatgctcagcgtcaggcaaccaaagacgcaggccgtatcgctggtctggaagtaaaacgtatcatcaacgaaccgaccgcagctgcgctggcttacggtctggacaaaggcactggcaaccgtactatcgcggtttatgacctgggtggtggtactttcgatatttctattatcgaaatcgacgaagttgacggcgaaaaaaccttcgaagttctggcaaccaacggtgatacccacctggggggtgaagacttcgacagccgtctgatcaactatctggttgaagaattcaagaaagatcagggcattgacctgcgcaacgatccgctggcaatgcagcgcctgaaagaagcggcagaaaaagcgaaaatcgaactgtcttccgctcagcagaccgacgttaacctgccatacatcactgcagacgcgaccggtccgaaacacatgaacatcaaagtgactcgtgcgaaactggaaagcctggttgaagatctggtaaaccgttccattgagccgctgaaagttgcactgcaggacgctggcctgtccgtatctgatatcgacgacgttatcctcgttggtggtcagactcgtatgccaatggttcagaagaaagttgctgagttctttggtaaagagccgcgtaaagacgttaacccggacgaagctgtagcaatcggtgctgctgttcagggtggtgttctgactggtgacgtaaaagacgtactgctgctggacgttaccccgctgtctctgggtatcgaaaccatgggcggtgtgatgacgacgctgatcgcgaaaaacaccactatcccgaccaagcacagccaggtgttctctaccgctgaagacaaccagtctgcggtaaccatccatgtgctgcagggtgaacgtaaacgtgcggctgataacaaatctctgggtcagttcaacctagatggtatcaacccggcaccgcgcggcatgccgcagatcgaagttaccttcgatatcgatgctgacggtatcctgcacgtttccgcgaaagataaaaacagcggtaaagagcagaagatcaccatcaaggcttcttctggtctgaacgaagatgaaatccagaaaatggtacgcgacgcagaagctaacgccgaagctgaccgtaagtttgaagagctggtacagactcgcaaccagggcgaccatctgctgcacagcacccgtaagcaggttgaagaagcaggcgacaaactgccggctgacgacaaaactgctatcgagtctgcgctgactgcactggaaactgctctgaaaggtgaagacaaagccgctatcgaagcgaaaatgcaggaactggcacaggtttcccagaaactgatggaaatcgcccagcagcaacatgcccagcagcagactgccggtgctgatgcttctgcaaacaacgcgaaagatgacgatgttgtcgacgctgaatttgaagaagtcaaagacaaaaaataatcgccctataaacgggtaattatactgacacgggcgaaggggaatttcctctccgcccgtgcattcatctaggggcaatttaaaaaagatggctaagcaagattattacgagattttaggcgtttccaaaacagcggaagagcgtgaaatcagaaaggcctacaaacgcctggccatgaaataccacccggaccgtaaccagggtgacaaagaggccgaggcgaaatttaaagagatcaaggaagcttatgaagttctgaccgactcgcaaaaacgtgcggcatacgatcagtatggtcatgctgcgtttgagcaaggtggcatgggcggcggcggttttggcggcggcgcagacttcagcgatatttttggtgacgttttcggcgatatttttggcggcggacgtggtcgtcaacgtgcggcgcgcggtgctgatttacgctataacatggagctcaccctcgaagaagctgtacgtggcgtgaccaaagagatccgcattccgactctggaagagtgtgacgtttgccacggtagcggtgcaaaaccaggtacacagccgcagacttgtccgacctgtcatggttctggtcaggtgcagatgcgccagggattcttcgctgtacagcagacctgtccacactgtcagggccgcggtacgctgatcaaagatccgtgcaacaaatgtcatggtcatggtcgtgttgagcgcagcaaaacgctgtccgttaaaatcccggcaggggtggacactggagaccgcatccgtcttgcgggcgaaggtgaagcgggcgagcatggcgcaccggcaggcgatctgtacgttcaggttcaggttaaacagcacccgattttcgagcgtgaaggcaacaacctgtattgcgaagtcccgatcaacttcgctatggcggcgctgggtggcgaaatcgaagtaccgacccttgatggtcgcgtcaaactgaaagtgcctggcgaaacccagaccggtaagctattccgtatgcgcggtaaaggcgtcaagtctgtccgcggtggcgcacagggtgatttgctgtgccgcgttgtcgtcgaaacaccggtaggcctgaacgaaaggcagaaacagctgctgcaagagctgcaagaaagcttcggtggcccaaccggcgagcacaacagcccgcgctcaaagagcttctttgatggtgtgaagaagttttttgacgacctgacccgctaacctccccaaaagcctgcccgtgggcaggcctgggtaaaaatagggtgcgttgaagatatgcgagcacctgtaaagtggcggggatcactcccataagcgctaacttaagggttgtggtattacgcctgatatgatttaacgtgccgatgaattactctcacgataactggtcagcaattctggcccatattggtaagcccgaagaactggatacttcggcacgtaatgccggggctctaacccgccgccgcgaaattcgtgatgctgcaactctgctacgtctggggctggcttacggccccggggggatgtcattacgtgaagtcactgcatgggctcagctccatgacgttgcaacattatctgacgtggctctcctgaagcggctgcggaatgccgccgactggtttggcatacttgccgcacaaacacttgctgtacgcgccgcagttacgggttgtacaagcggaaagagattgcgtcttgtcgatggaacagcaatcagtgcgcccgggggcggcagcgctgaatggcgactacatatgggatatgatcctcatacctgtcagttcactgattttgagctaaccgacagcagagacgctgaacggctggaccgatttgcgcaaacggcagacgagatacgcattgctgaccggggattcggttcgcgtcccgaatgtatccgctcacttgcttttggagaagctgattatatcgtccgggttcactggcgaggattgcgctggttaactgcagaaggaatgcgctttgacatgatgggttttctgcgcgggctggattgcggtaagaacggtgaaaccactgtaatgataggcaattcaggtaataaaaaagccggagctccctttccggcacgtctcattgccgtatcacttcctcccgaaaaagcattaatcagtaaaacccgactgctcagcgagaatcgtcgaaaaggacgagtagttcaggcggaaacgctggaagcagcgggccatgtgctattgctaacatcattaccggaagatgaatattcagcagagcaagtggctgattgttaccgtctgcgatggcaaattgaactggcttttaagcggctcaaaagtttgctgcacctggatgctttgcgtgcaaaggaacctgaactcgcgaaagcgtggatatttgctaatctactcgccgcatttttaattgacgacataatccagccatcgctggatttcccccccagaagtgccggatccgaaaagaagaactaactcgttgtggagaataacaaaaatggtcatctggagcttacaggtggccattcgtgggacagtatccctgacagcctacaaaacgcaattgaagaacgcgaggcatcgtcttaacgaggcaccgaggcgtcgcattcttcagatggttcaacccttaagttagcgcttatgggatcactccccgccgttgctcttactcggattcgtaagccgtgaaaacagcaacctccgtctggccagttcggatgtgaacctcacagaggtcttttctcgttaccagcgccgccactacggcggtgatacagatgacgatcagggcgacaatcatcgccttatgctgcttcattgctctcttctccttgaccttacggtcagtaagaggcactctacatgtgttcagcatataggaggcctcgggttgatggtaaaatatcactcggggcttttctctatctgccgttcagctaatgcctgagacagacagcctcaagcacccgccgctattatatcgctctctttaacccattttgttttatcgattctaatcctgaagacgcctcgcatttttgtggcgtaattttttaatgatttaattatttaactttaatttatctcttcatcgcaattattgacgacaagctggattatttttgaaatattggcctaacaagcatcgccgactgacaacaaattaattattacttttcctaattaatccctcaggaatcctcaccttaagctatgattatctaggcttagggtcactcgtgagcgcttacagccgtcaaaaacgcatctcaccgctgatggcgcaaattcttcaatagctcgtaaaaaacgaattattcctacactataatctgattttaacgatgattcgtgcggggtaaaatagtaaaaacgatctattcacctgaaagagaaataaaaagtgaaacatctgcatcgattctttagcagtgatgcctcgggaggcattattcttatcattgccgctatcctggcgatgattatggccaacagcggcgcaaccagtggatggtatcacgactttctggagacgccggttcagctccgggttggttcactcgaaatcaacaaaaacatgctgttatggataaatgacgcgctgatggcggtatttttcctgttagtcggtctggaagttaaacgtgaactgatgcaaggatcgctagccagcttacgccaggccgcatttccagttatcgccgctattggtgggatgattgtgccggcattactctatctggcttttaactatgccgatccgattacccgcgaagggtgggcgatcccggcggctactgacattgcttttgcacttggtgtactggcgctgttgggaagtcgtgttccgttagcgctgaagatctttttgatggctctggctattatcgacgatcttggggccatcattatcatcgcattgttctacactaatgacttatcgatggcctctcttggcgtcgcggctgtagcaattgcggtactcgcggtattgaatctgtgtggtgcacgccgcacgggcgtctatattcttgttggcgtggtgttgtggactgcggtgttgaaatcgggggttcacgcaactctggcgggggtaattgtcggcttctttattcctttgaaagagaagcatgggcgttctccagcgaagcgactggagcatgtgttgcacccgtgggtggcgtatctgattttgccgctgtttgcatttgctaatgctggcgtttcactgcaaggcgtcacgctggatggcttgacctccattctgccattggggatcatcgctggcttgctgattggcaaaccgctggggattagtctgttctgctggttggcgctgcgtttgaaactggcgcatctgcctgagggaacgacttatcagcaaattatggtggtggggatcctgtgcggtatcggttttactatgtctatctttattgccagcctggcctttggtagcgtagatccagaactgattaactgggcgaaactcggtatcctggtcggttctatctcttcggcggtaattggatacagctggttacgcgttcgtttgcgtccatcagtttgacaggacggtttaccggggagccataaacggctcccttttcattgttatcagggagagaaatgagcatgtctcatatcaattacaaccacttgtattacttctggcatgtctataaagaaggttccgtggttggcgcagcggaggcgctttatttaactccacaaaccattaccggacagattcgagcgctggaagagcgcctgcaaggcaaattatttaaacgcaagggacgtggtctcgaacccagcgagctgggagaactggtctatcgctatgccgataaaatgttcaccttaagccaggaaatgctggatattgtgaactatcgcaaagaatccaatttattgtttgacgttggcgtggctgatgcactttccaaacgcctggtcagtagcgtacttaacgccgcagtggtagaaggcgagcccattcatcttcgctgcttcgaatccacccacgaaatgctgctggagcaattaagtcagcataaactggatatgatcatttctgactgtccgatagactctacgcagcaggaaggcctgttctccgtgagaattggcgaatgtggcgtgagtttctggtgtacaaatccaccaccagaaaaaccgttcccggcttgtctggaagaacggcgacttttgattcctgggcgacgttcaatgttagggcgcaaattgcttaactggtttaactcccagggattaaacgtagaaatcctcggcgagtttgatgatgccgctttgatgaaagcttttggtgcgatgcacaatgcaatcttcgttgccccaacgctttatgcatatgacttttatgccgataaaactgtcgtagaaattggtcgcgtcgagaatgtgatggaagagtaccatgctatttttgctgagcggatgattcagcacccggcggtacagcgaatctgcaatacggattattctgcgctttttagtccagcggtgcgttaatcggcagctcccccaaagttaaggtgggggagatagattagttgtacattaccacgattttgactcggctcattatttgcccgcttgagacattgtttccatatgtacgcgggcgaataaatagaggaatctgattacttccttcatggggatgctgaaaagagtagtaattgctggtaatgactccaacttattgatagtgttttatgttcagataatgcccgatgactttgtcatgcagctccaccgattttgagaacgacagcgacttccgtcccagccgtgccaggtgctgcctcagattcaggttatgccgctcaattcgctgcgtatatcgcttgctgattacgtgcagctttcccttcaggcgggattcatacagcggccagccatccgtcatccatatcaccacgtcaaagggtgacagcaggctcataagacgccccagcgtcgccatagtgcgttcaccgaatacgtgcgcaacaaccgtcttccggagactgtcatacgcgtaaaacagccagcgctggcgcgatttagccccgacatagccccactgttcgtccatttccgcgcagacgatgacgtcactgcccggctgtatgcgcgaggttaccgactgcggcctgagttttttaagtgacgtaaaatcgtgttgaggccaacgcccataatgcgggctgttgcccggcatccaacgccattcatggccatatcaatgattttctggtgcgtaccgggttgagaagcggtgtaagtgaactgcagttgccatgttttacggcagtgagagcagagatagcgctgatgtccggcggtgcttttgccgttacgcaccaccccgtcagtagctgaacaggagggacagctgatagaaacagaagccactggagcacctcaaaaacaccatcatacactaaatcagtaagttggcagcatcacctacctcaatgtgtatcacaatatccatattctttgtgggggagtctggagattgagtagatattcttgttcagaatgtatcagccgatggttctacgattcttaagccacgaagagttcagatagtacaacggcatgtctcttttgactatctggcaaccggcagtgtgttctctcacgcatcacaaaagcagcaggcataaaaaaacccgcttgcgcgggctttttcacaaagcttcagcaaattggcgattaagccagtttgttgatctgtgcagtcaggttagccttatgacgtgcagctttgtttttgtggatcagacctttagcagcctgacggtccacgatcggttgcatttcgttaaatgctttctgtgcagcagctttgtcgccagcttcgatagctgcgtatactttcttgatgaaagtacgcatcatagagcgacggcttgcgttgtgcttacgagccttttcagactgaatggcgcgcttcttagctgatttgatattagccaaggtccaactcccaaatgtgttctatatggacaattcaaaggccgaggaatatgcccttttagccttcttttgtcaatggatttgtgcaaataagcgccgttaatgtgccggcactcgttacgtagtgatggcgcaggattctaccagcttgcggggtgtgaatacagcttttccgcgataaaaattgcagcaggcggtcagtttcttcccgtgatttgcgccatggcaatgaaaagccacttctttctgatttcggtactcaatcgccggttaaccttgaccgctgtacaaggtatactcggacgattttcactgttttgagccagacatgaagctgatacgcggcatacataatctcagccaggccccgcaagaagggtgtgtgctgactattggtaatttcgacggcgtgcatcgcggtcatcgcgcgctgttacagggcttgcaggaagaagggcgcaagcgcaacttaccggtgatggtgatgctttttgaacctcaaccactggaactgtttgctaccgataaagccccggcaagactgacccggctgcgggaaaaactgcgttaccttgcagagtgtggcgttgattacgtgctgtgcgtgcgtttcgacaggcgtttcgcggcgttaaccgcgcaaaatttcatcagcgatcttctggtgaagcatttgcgcgtaaaatttcttgccgtaggtgatgatttccgctttggcgctggtcgtgaaggcgatttcttgttattacagaaagctggcatggaatacggcttcgatatcaccagtacgcaaactttttgcgaaggtggcgtgcgcatcagcagcaccgccgtgcgtcaggcccttgcggatgacaatctggctctggcagagagtttactggggcacccgtttgccatctccgggcgtgtagtccacggtgatgaattagggcgcactataggtttcccgacggcgaatgtaccgctgcgccgtcaggtttccccggtgaaaggggtttatgcggtagaagtgctgggcctcggtgaaaagccgttacccggcgtggcaaacatcggaacacgcccaacggttgccggtattcgccagcagctggaagtgcatttgttagatgttgcaatggacctttacggtcgccatatacaagtagtgctgcgtaaaaaaatacgcaatgagcagcgatttgcgtcgctggacgaactgaaagcgcagattgcgcgtgatgaattaaccgcccgcgaattttttgggctaacaaaaccggcttaagcctgttatgtaatcaaaccgaaatacggaaccgagaatctgatgagtgactataaatcaaccctgaatttgccggaaacagggttcccgatgcgtggcgatctcgccaagcgcgaacccggaatgctggcgcgttggactgatgatgatctgtacggcatcatccgtgcggctaaaaaaggcaaaaaaaccttcattctgcatgatggccctccttatgcgaatggcagcattcatattggtcactcggttaacaagattctgaaagacattatcgtgaagtccaaagggctttccggttatgactcgccgtatgtgcctggctgggactgccacggtctgccgatcgagctgaaagtcgagcaagaatacggtaagccgggtgagaaattcaccgccgccgagttccgcgccaagtgccgcgaatacgcggcgacccaggttgacggtcaacgcaaagactttatccgtctgggcgtgctgggcgactggtcgcacccgtacctgaccatggacttcaaaactgaagccaacatcatccgcgcgctgggcaaaatcatcggcaacggtcacctgcacaaaggcgcgaagccagttcactggtgcgttgactgccgttctgcgctggcggaagcggaagttgagtattacgacaaaacttctccgtccatcgacgttgctttccaggcagtcgatcaggatgcactgaaagcaaaatttgccgtaagcaacgttaacggcccaatctcgctggtaatctggaccaccacgccgtggactctgcctgccaaccgcgcaatctctattgcaccagatttcgactatgcgctggtgcagatcgacggtcaggccgtgattctggcgaaagatctggttgaaagcgtaatgcagcgtatcggcgtgaccgattacaccattctcggcacggtaaaaggtgcggagcttgagctgctgcgctttacccatccgtttatgggcttcgacgttccggcaatcctcggcgatcacgttaccctggatgccggtaccggtgccgttcacaccgcgcctggccacggcccggacgactatgtgatcggtcagaaatacggcctggaaaccgctaacccggttggcccggacggcacttatctgccgggcacttatccgacgctggatggcgtgaacgtcttcaaagcgaacgacatcgtcgttgcgctgctgcaggaaaaaggcgcgctgctgcacgttgagaaaatgcagcacagctatccgtgctgctggcgtcacaaaacgccgatcatcttccgcgcgacgccgcagtggttcgtcagcatggatcagaaaggtctgcgtgcgcagtcactgaaagagatcaaaggcgtgcagtggatcccggactggggccaggcgcgtatcgagtcgatggttgctaaccgtcctgactggtgtatctcccgtcagcgcacctggggtgtaccgatgtcactgttcgtgcacaaagacacggaagagctgcatccgcgtacccttgaactgatggaagaagtggcaaaacgcgttgaagtcgatggcatccaggcgtggtgggatctcgatgcgaaagagatcctcggcgacgaagctgatcagtacgtgaaagtgccggacacattggatgtatggtttgactccggatctacccactcttctgttgttgacgtgcgtccggaatttgccggtcacgcagcggacatgtatctggaaggttctgaccaacaccgcggctggttcatgtcttccctaatgatctccaccgcgatgaagggtaaagcgccgtatcgtcaggtactgacccacggctttaccgtggatggtcagggccgcaagatgtctaaatccatcggcaataccgtttcgccgcaggatgtgatgaacaaactgggcgcggatattctgcgtctgtgggtggcatcaaccgactacaccggtgaaatggccgtttctgacgagatcctgaaacgtgctgccgatagctatcgtcgtatccgtaacaccgcgcgcttcctgctggcaaacctgaacggttttgatccagcaaaagatatggtgaaaccggaagagatggtggtactggatcgctgggccgtaggttgtgcgaaagcggcacaggaagacatcctcaaggcgtacgaagcatacgatttccacgaagtggtacagcgtctgatgcgcttctgctccgttgagatgggttccttctacctcgacatcatcaaagaccgtcagtacaccgccaaagcggacagtgtggcgcgtcgtagctgccagactgcgctatatcacatcgcagaagcgctggtgcgctggatggcaccaatcctctccttcaccgctgatgaagtgtggggctacctgccgggcgaacgtgaaaaatacgtcttcaccggtgagtggtacgaaggcctgtttggcctggcagacagtgaagcgatgaacgatgcgttctgggacgagctgttgaaagtgcgtggcgaagtgaacaaagtcattgagcaagcgcgtgccgacaagaaagtgggtggctcgctggaagcggcagtaaccttgtatgcagaaccggaactgtcggcgaaactgaccgcgctgggcgatgaattacgatttgtcctgttgacctccggcgctaccgttgcagactataacgacgcacctgctgatgctcagcagagcgaagtactcaaagggctgaaagtcgcgttgagtaaagccgaaggtgagaagtgcccacgctgctggcactacacccaggatgtcggcaaggtggcggaacacgcagaaatctgcggccgctgtgtcagcaacgtcgccggtgacggtgaaaaacgtaagtttgcctgatgagtcaatcgatctgttcaacagggctacgctggctgtggctggtggtagtcgtgctgattatcgatctgggcagcaaatacctgatcctccagaactttgctctgggggatacggtcccgctgttcccgtcgcttaatctgcattatgcgcgtaactatggcgcggcgtttagtttccttgccgatagcggcggctggcagcgttggttctttgccggtattgcgattggtattagcgtgatcctggcagtgatgatgtatcgctcgaaggccacgcagaagctaaacaatatcgcttacgcgctgattattggcggcgcgctgggcaacctgttcgaccgcctgtggcacggcttcgttgtcgatatgatcgacttctacgtcggcgactggcacttcgccaccttcaaccttgccgatactgccatctgtgtcggtgcggcactgattgtgctggaaggttttttgccttctagagcgaaaaaacaataataaaccctgccggatgcgatgctgacgcatcttatccggcctacagattgctgcgaaatcgtaggccggataaggcgtttacgccgcatccggcaaaaatccttaaatataagagcaaacctgcatgtctgaatctgtacagagcaatagcgccgtcctggtgcacttcacgctaaaactcgacgatggcaccaccgccgagtctacccgcaacaacggtaaaccggcgctgttccgcctgggtgatgcttctctttctgaagggctggagcaacacctgttggggctgaaagtgggcgataaaaccaccttctcgttggagccagatgcggcgtttggcgtgccgtcaccggacctgattcagtacttctcccgccgtgaatttatggatgcaggcgagccagaaattggcgcaatcatgctttttaccgcaatggatggcagtgagatgcctggcgtgatccgcgaaattaacggcgactccattaccgttgatttcaaccatccgctggccgggcagaccgttcattttgatattgaagtgctggaaatcgatccggcactggaggcgtaacatgcagatcctgttggccaacccgcgtggtttttgtgccggggtagaccgcgctatcagcattgttgaaaacgcgctggccatttacggcgcaccgatatatgtccgtcacgaagtggtacataaccgctatgtggtcgatagcttgcgtgagcgtggggctatctttattgagcagattagcgaagtaccggacggcgcgatcctgattttctccgcacacggtgtttctcaggcggtacgtaacgaagcaaaaagtcgcgatttgacggtgtttgatgccacctgtccgctggtgaccaaagtgcatatggaagtcgcccgcgccagtcgccgtggcgaagaatctattctcatcggtcacgccgggcacccggaagtggaagggacaatgggccagtacagtaacccggaagggggaatgtatctggtcgaatcgccggacgatgtgtggaaactgacggtcaaaaacgaagagaagctctcctttatgacccagaccacgctgtcggtggatgacacgtctgatgtgatcgacgcgctgcgtaaacgcttcccgaaaattgtcggtccgcgcaaagatgacatctgctacgccacgactaaccgtcaggaagcggtacgcgccctggcagaacaggcggaagttgtgttggtggtcggttcgaaaaactcctccaactccaaccgtctggcggagctggcccagcgtatgggcaaacgcgcgtttttgattgacgatgcgaaagacatccaggaagagtgggtgaaagaggttaaatgcgtcggcgtgactgcgggcgcatcggctccggatattctggtgcagaatgtggtggcacgtttgcagcagctgggcggtggtgaagccattccgctggaaggccgtgaagaaaacattgttttcgaagtgccgaaagagctgcgtgtcgatattcgtgaagtcgattaagtcattagcagcctaagttatgcgaaaatgccggtcttgttaccggcattttttatggagaaaacatgcgtttacctatcttcctcgatactgaccccggcattgacgatgccgtcgccattgccgccgcgatttttgcacccgaactcgacctgcaactgatgaccaccgtcgcgggtaatgtctcggttgagaaaactacccgcaatgccctgcaactgctgcatttctggaatgcggagattccgctcgcccaaggggccgctgtgccactggtacgcgcaccgcgtgatgcggcatctgtgcacggcgaatcgggaatggctggctacgactttgttgagcacaaccgaaagccgctcgggataccggcgtttctggcgattcgggatgccctgatgcgtgcaccagagcctgttaccctggtggccatcggcccgttaaccaatattgcgctgttactttcacaatgcccggaatgcaagccgtatattcgccgtctggtgatcatgggtggttctgccggacgcggcaactgtacgccaaacgccgagtttaatattgctgccgatccagaagctgctgcctgtgtcttccgcagtggtattgaaatcgtcatgtgcggtttggatgtcaccaatcaggcaatattaactcctgactatctctctacactgccgcagttaaaccgtaccgggaaaatgcttcacgccctgtttagccactaccgtagcggcagtatgcaaagcggcttgcgaatgcacgatctctgcgccatcgcctggctggtgcgcccggacctgttcactctcaaaccctgttttgtggcagtggaaactcagggcgaatttacctcaggcacgacggtggttgatatcgacggttgcctgggcaagccagccaatgtacaggtggcattggatctggatgtgaaaggcttccagcagtgggtggctgaggtgctggctctggcgtcgtaacctgtcacatgttattggcatgcagtcattcatcgactcatgcctttcactgatatccctccctgtttatcattaatttctaattatcagcgtttttggctggcggcgtagcgatgcgctggttactctgaaaacggtctatgcaaattaacaaaagagaatagctatgcatgatgcaaacatccgcgttgccatcgcgggagccggggggcgtatgggccgccagttgattcaggcggcgctggcattagagggcgtgcagttgggcgctgcgctggagcgtgaaggatcttctttactgggcagcgacgccggtgagctggccggagccgggaaaacaggcgttaccgtgcaaagcagcctcgatgcggtaaaagatgattttgatgtgtttatcgattttacccgtccggaaggtacgctgaaccatctcgctttttgtcgccagcatggcaaagggatggtgatcggcactacggggtttgacgaagccggtaaacaagcaattcgtgacgccgctgccgatattgcgattgtctttgctgccaattttagcgttggcgttaacgtcatgcttaagctgctggagaaagcagccaaagtgatgggtgactacaccgatatcgaaattattgaagcacatcatagacataaagttgatgcgccgtcaggcaccgcactggcaatgggagaggcgatcgcccacgcccttgataaagatctgaaagattgcgcggtctacagtcgtgaaggccacaccggtgaacgtgtgcctggcaccattggttttgccaccgtgcgtgcaggtgacatcgttggtgaacataccgcgatgtttgccgatattggcgagcgtctggagatcacccataaggcgtccagccgtatgacatttgctaacggcgcggtaagatcggctttgtggttgagtggtaaggaaagcggtctttttgatatgcgagatgtacttgatctcaataatttgtaaccacaaaatatttgttatggtgcaaaaataacacatttaatttattgattataaagggctttaatttttggcccttttatttttggtgttatgtttttaaattgtctataagtgccaaaaattacatgttttgtcttctgtttttgttgttttaatgtaaattttgaccatttggtccacttttttctgctcgtttttatttcatgcaatcttcttgctgcgcaagcgttttccagaacaggttagatgatctttttgtcgcttaatgcctgtaaaacatgcatgagccacaaaataatataaaaaatcccgccattaagttgacttttagcgcccatatctccagaatgccgccgtttgccagaaattcgtcggtaagcagatttgcattgatttacgtcatcattgtgaattaatatgcaaataaagtgagtgaatattctctggagggtgttttgattaagtcagcgctattggttctggaagacggaacccagtttcacggtcgggccataggggcaacaggttcggcggttggggaagtcgttttcaatacttcaatgaccggttatcaagaaatcctcactgatccttcctattctcgtcaaatcgttactcttacttatccccatattggcaatgtcggcaccaatgacgccgatgaagaatcttctcaggtacatgcacaaggtctggtgattcgcgacctgccgctgattgccagcaacttccgtaataccgaagacctctcttcttacctgaaacgccataacatcgtggcgattgccgatatcgatacccgtaagctgacgcgtttactgcgcgagaaaggcgcacagaatggctgcattatcgcgggcgataacccggatgcggcgctggcgttagaaaaagcccgcgcgttcccaggtctgaatggcatggatctggcaaaagaagtgaccaccgcagaagcctatagctggacacaagggagctggacgttgaccggtggcctgccagaagcgaaaaaagaagacgagctgccgttccacgtcgtggcttatgattttggtgccaagcgcaacatcctgcggatgctggtggatagaggctgtcgcctgaccatcgttccggcgcaaacttctgcggaagatgtgctgaaaatgaatccagacggcatcttcctctccaacggtcctggcgacccggccccgtgcgattacgccattaccgccatccagaaattcctcgaaaccgatattccggtattcggcatctgtctcggtcatcagctgctggcgctggcgagcggtgcgaagactgtcaaaatgaaatttggtcaccacggcggcaaccatccggttaaagatgtggagaaaaacgtggtaatgatcaccgcccagaaccacggttttgcggtggacgaagcaacattacctgcaaacctgcgtgtcacgcataaatccctgttcgacggtacgttacagggcattcatcgcaccgataaaccggcattcagcttccaggggcaccctgaagccagccctggtccacacgacgccgcgccgttgttcgaccactttatcgagttaattgagcagtaccgtaaaaccgctaagtaatcaggagtaaaagagccatgccaaaacgtacagatataaaaagtatcctgattctgggtgcgggcccgattgttatcggtcaggcgtgtgagtttgactactctggcgcgcaagcgtgtaaagccctgcgtgaagagggttaccgcgtcattctggtgaactccaacccggcgaccatcatgaccgacccggaaatggctgatgcaacctacatcgagccgattcactgggaagttgtacgcaagattattgaaaaagagcgcccggacgcggtgctgccaacgatgggcggtcagacggcgctgaactgcgcgctggagctggaacgtcagggcgtgttggaagagttcggtgtcaccatgattggtgccactgccgatgcgattgataaagcagaagaccgccgtcgtttcgacgtagcgatgaagaaaattggtctggaaaccgcgcgttccggtatcgcacacacgatggaagaagcgctggcggttgccgctgacgtgggcttcccgtgcattattcgcccatcctttaccatgggcggtagcggcggcggtatcgcttataaccgtgaagagtttgaagaaatttgcgcccgcggtctggatctctctccgaccaaagagttgctgattgatgagtcgctgatcggctggaaagagtacgagatggaagtggtgcgtgataaaaacgacaactgcatcatcgtctgctctatcgaaaacttcgatgcgatgggcatccacaccggtgactccatcactgtcgcgccagcccaaacgctgaccgacaaagaatatcaaatcatgcgtaacgcctcgatggcggtgctgcgtgaaatcggcgttgaaaccggtggttccaacgttcagtttgcggtgaacccgaaaaacggtcgtctgattgttatcgaaatgaacccacgcgtgtcccgttcttcggcgctggcgtcgaaagcgaccggtttcccgattgctaaagtggcggcgaaactggcggtgggttacaccctcgacgaactgatgaacgacatcactggcggacgtactccggcctccttcgagccgtccatcgactatgtggttactaaaattcctcgcttcaacttcgaaaaattcgccggtgctaacgaccgtctgaccactcagatgaaatcggttggcgaagtgatggcgattggtcgcacgcagcaggaatccctgcaaaaagcgctgcgcggcctggaagtcggtgcgactggattcgacccgaaagtgagcctggatgacccggaagcgttaaccaaaatccgtcgcgaactgaaagacgcaggcgcagatcgtatctggtacatcgccgatgcgttccgtgcgggcctgtctgtggacggcgtcttcaacctgaccaacattgaccgctggttcctggtacagattgaagagctggtgcgtctggaagagaaagtggcggaagtgggcatcactggcctgaacgctgacttcctgcgccagctgaaacgcaaaggctttgccgatgcgcgcttggcaaaactggcgggcgtacgcgaagcggaaatccgtaagctgcgtgaccagtatgacctgcacccggtttataagcgcgtggatacctgtgcggcagagttcgccaccgacaccgcttacatgtactccacttatgaagaagagtgcgaagcgaatccgtctaccgaccgtgaaaaaatcatggtgcttggcggcggcccgaaccgtatcggtcagggtatcgaattcgactactgttgcgtacacgcctcgctggcgctgcgcgaagacggttacgaaaccattatggttaactgtaacccggaaaccgtctccaccgactacgacacttccgaccgcctctacttcgagccggtaactctggaagatgtgctggaaatcgtgcgtatcgagaagccgaaaggcgttatcgtccagtacggcggtcagaccccgctgaaactggcgcgcgcgctggaagctgctggcgtaccggttatcggcaccagcccggatgctatcgaccgtgcagaagaccgtgaacgcttccagcatgcggttgagcgtctgaaactgaaacaaccggcgaacgccaccgttaccgctattgaaatggcggtagagaaggcgaaagagattggctacccgctggtggtacgtccgtcttacgttctcggcggtcgggcgatggaaatcgtctatgacgaagctgacctgcgtcgctacttccagacggcggtcagcgtgtctaacgatgcgccagtgttgctggaccacttcctcgatgacgcggtagaagttgacgtggatgccatctgcgacggcgaaatggtgctgattggcggcatcatggagcatattgagcaggcgggcgtgcactccggtgactccgcatgttctctgccagcctacaccttaagtcaggaaattcaggatgtgatgcgccagcaggtgcagaaactggccttcgaattgcaggtgcgcggcctgatgaacgtgcagtttgcggtgaaaaacaacgaagtctacctgattgaagttaacccgcgtgcggcgcgtaccgttccgttcgtctccaaagccaccggcgtaccgctggcaaaagtggcggcgcgcgtgatggctggcaaatcgctggctgagcagggcgtaaccaaagaagttatcccgccgtactactcggtgaaagaagtggtgctgccgttcaataaattcccgggcgttgacccgctgttagggccagaaatgcgctctaccggggaagtcatgggcgtgggccgcaccttcgctgaagcgtttgccaaagcgcagctgggcagcaactccaccatgaagaaacacggtcgtgcgctgctttccgtgcgcgaaggcgataaagaacgcgtggtggacctggcggcaaaactgctgaaacagggcttcgagctggatgcgacccacggcacggcgattgtgctgggcgaagcaggtatcaacccgcgtctggtaaacaaggtgcatgaaggccgtccgcacattcaggaccgtatcaagaatggcgaatatacctacatcatcaacaccacctcaggccgtcgtgcgattgaagactcccgcgtgattcgtcgcagtgcgctgcaatataaagtgcattacgacaccaccctgaacggcggctttgccaccgcgatggcgctgaatgccgatgcgactgaaaaagtaatttcggtgcaggaaatgcacgcacagatcaaataatagcgtgtcatggcagatatttttcatccgctaatttgatcgaataactaatacggttctctgatgaggaccgtttttttttgcccattaagtaaatcttttggggaatcgatatttttgatgacataagcaggatttagctcacacttatcgacggtgaagttgcatactatcgatatatccacaattttaatatggccttgtttaattgcttcaaaacgagtcatagccagacttttaatttgtgaaactggagttcgtatgtgtgaaggatatgttgaaaaaccactctacttgttaatcgccgaatggatgatggctgaaaatcggtgggtgatagcaagagagatctctattcatttcgatattgaacacagcaaggcggttaataccctgacttatattctgtcggaagtcacagaaataagctgcgaagttaagatgatccctaataagctggaagggcggggatgccagtgtcagcgactggttaaagtggtcgatatcgatgagcaaatttacgcgcgcctgcgcaataacagtcgggaaaaattagtcggtgtaagaaagacgccgcgtattcctgccgttccgctcacggaacttaaccgcgagcagaagtggcagatgatgttgtcaaagagtatgcgtcgttaattttatctcgttgataccgggcgtcctgcttgccagatgcgatgttgtagcatcttatccagcaaccaggtcgcatccggcaagatcaccgtttaggcgtcacatccgtcgtcccctgcaaacgggggcgattttcctccatttgcctcagtggctgcgtttcatgtaacgatacatgacagcgcccgacaagatcctgatactctttggtattcaaccgtttccagtgtaactcgtcgtcactaacattgcgtacagcgcgggctggcgtacccatcaacaactggcgtttctcgccgcgaaagcccgctttgacaaagctcatggcggcaacaatgctctcttcgccaatgaccgcgccatccataatcacgctgttcatcccgaccaatgcatcgcgaccaatcaaacaaccatgcaggatcgctccgtgcccgatatggccgttttccccaacgatagtgtcagtgtcgcagtagccatgcataatgcagccatcctgaatattggctcccgcttgcacgatcaaccgcccgtagtcaccacgcagtgaggcgagtgggccgatgtagacaccggctcccacaatcacatcgccaatcaagacggcactgggatggacaaacgccgtcgggtgaaccaccggaattaacccctcaaaggcgtaatagctcacggttgttaacgtcctttccacaccggatcgcgcttctcggcaaacgccagcggcccttcaatggcatcttccgaatgcagaaccgatggatagtgtttcaacacgccgctgcgaatatagcgatacgcttcttctaccggcatttcgctggtggtgcggtagatctctttcagcgccgcaatcgccagcggggcgctgttaaccagctgctgagccagttcgcgggcgttatccatcagttccgcctggctaaccacgcggttgactatcccccaacgcagcgcctcttctgcgcccattcgtctgccggtcatcaccatttcattgacgatggcaggcggcaggatcttcggcagacgcagcacaccgccgctgtcaggaacgatgcccagtttggcttccggcagggcgaagctggcgttatcggcacaaacaataaaatctgccgccagcgccagttcaaagccgccgccaaaggcatagccgttcacagctgcgataaccggtttgtcgagattgaaaatttcggttaatcccgcaaaaccacccggaccaaagtcagcatccggtgcttcgccttctgctgccgcttttaaatcccagcccgcggaaaagaacttctctccggcaccggtaataatggcgacacgtaattgcggatcgtcacggaaatttagaaatacttcgcccatttcaaagctggtttttgcatcaatagcattcgcttttggacgatcaagggtaatttccagaattgatccattgcgggtcagatgtaatgattcactcattccttttctccatttttgctttttcagggacgacaacatccctgcaaaaaatgcatattgttttagagtgtgattattagctggcagggtagttccctgctgtttcatttatttcagattctttctaattattttccccgagcaattacgtggcagatcttttctgatctccagataagagggcactttaaatttcgccatattttgttcgcagaagcggaaaaattcctcttcgctcaatgtttcaccttcattcagcaccacaaatgctttgatggcttcatcgcgaatcgaatctttaatacccacaaccacgatgtcctgaattttcgggtgcgcggcgataatattttccagctccacgcaggagacattctcgccgccacgtttaatcatattgcagcggcgatcgacgaaataaaaaaagtcctcttcgtcgcggtatccggtatcgccggtatgcagccagccatcggcttccagcactttcgcagtggcttgtgggttgagaaagtactctttgaagatggttttcccaggtatgcctttaatgcagatttcaccgatctcaccagccgggagcgggcgattgtgatcgtcgcggatctccgcttcgtagcaaaaccccacccgaccaatcgacggccagcgtcgtttatcgccaggacgatcgccgataatgcccacaatggtttccgtcatcccataagacgtcagcaagcgaacgccgaagcgttcacaaaacgcatctttttcctgctccgacaagttgagataaaacatcacttcccgcaggcggtgttgctgatcgttcgctgaaggcggctgtaccatcaacgtacggatcatcatcggaatacattcggtaacggtggcgcggtacttctgtacctgtccccagaaggcgcgggcgctgtatttctcgaccagcacaaaggtggccccggcagaaaacgccgccatcgccgcagtacactggcaatcgatatgaaacgcaggcattaccgtcaggtagacgtcatcgtcacgcagtgcacactgccaggcggagtaatatccagcgaagcgcaggttgtaatgggtaatcaccacacctttcggtcgggaggtggtgccggaggtgaagagaatttccgccgtatcgtcagtcgatagcggcggtgcatagcacaaggtggcaggttgttgatttttcagttgagtaaacgaactcacgccatcatcagcgggaagtgccacatctgtcaggcaaatgtgccgcaattgagtggcatcttcctgctgaatctgttgatacataggatagaattgcgcactggtcaccagcaggcacgcctggctattttgcaggatccacgcgctttcctcgcacaacaggcgggcgttaatcggcaccataatcgcgccaatttttgccagcccgaaccagcaaaagataaattccgggcagttgtcgagatgtagtgcaaccttgtcgcctttgcgaatccccagcgtataaaacaggtttgccgtgcggttaatctcctgatttaactcaagataactataccggttaacgactccgccgctggattcacaaatcagcgccgttttatgaccgtaaacgtccgcaagatcgtcccacatttgacgtagatgttgtccgccaatgatatccattgcacctctatccatttttgttcgtttgttattgggcgggcgctagtcaggcaagccgactgacgccacgcgtttagtcctcaactttggccagacctttgctgaccaactcctgaatgtcgttttcgctgtagccgatatttttcaaaatggcagccgtgtccatgccatgtgagggcattccgcgccagatttgtccggggttatttttgaatttcggcatgatgttcggccctttgcaggtgcgaccatccatcgtttgccactgagtgattgattcgcgagccacatactgtggattgctttccagttccggtacggtcagcactttggcgcaggcgatattcagttcagcaaagcgttcttttacttccgcgatggtatgtgtcgccagccaggcatcgagtttctcttcaaccagtgggccgtaagggcattcgatacggtggataagctgagtgccttccgggatttctggcgtgccaagcagatgtgcgaggccaatatctttaaagcactcttcaatttgggtaatgcccaccagttccatcacgatgtagccgtcggcacatttatacagaccgcaaccggcgtagtagggatctttacctttgctcatgcgcgggcacatttcgccgccgttgaagtaatccatcatgaagtactggcccatacgcagcatcacttcatacatggcgatgtcgatactttcgcctttaccggtttcacgcactttatgcagtgctgccagcgccgccgtggtggcggtcaggccagaaaagtaatcggcggtatacgggaaggcaggcattggctggtcaacatcaccgttctgaatcaggtaaccactaaaggcctgggcgatagtgttataggccggaagattggtgtactcctcggtgccgtactgaccaaaaccggacaggtgagcgataaccagtttcgggttgtgctgccacagtacttcatcggtaatgccacgacgggcaaaggccggacctttactggcttcgatgaagatatcggtggtttccattaatttcagaaacgcttcgcggccttcatctttgaaaatatttaacgacagcgcgtgcaaattgcggcgggagagttgcgggtagttcggttgaacgcgaatggtgtcggcccaggcgacgttctcgatccagataacttccgcgccccattctgcgaacatttgcccggcaaacggtccggcgatttcgataccggagaagacaacgcgcaatccggccaacggcccgaatttcggcatgggtagatgatccattatttgctcctgaaaaatttatgtagcgcatgactgccggatgcggcgtaaacgctttatccggcctacattcgtgctcccgtaggcctgataagacgcatcagcgtcgcatcaggcagcgcacggacttagcggtattgcttcagcaccgcacgacccagcgtcaggatctgcatttcgtcagatcccccggagacgcggtctacacgcagatcacgccagaagcggctgatgcggtggttgcccgcaatcccgacaccgcccagcacctgcattgcgctatccacaacttcaaatgccgcattggcgcagaagtatttgcacatcgctgcatcgccagaggtgatggtgccgttgtctgctttccacgctgcttcatacagcatgtttttcatggagtttaatttgatcgccatgtgggcgaatttttcctgaatcaactggaaacgaccaatagcctcgccaaactgcacgcgctgattggcgtagcgcgccgcatcttcaaaggcgcacatcgccgtaccgtagttggtgagggctaccaggaaacgttcatggtcgaactcttctttgacgcggttaaagccgttaccttcccgaccgaacatgtctttctcgtccagttccacgtcgtcaaaggtgatttcacagcagctatccatacgcagaccgagcttttcaagtttggtcactttgatgcccggtttgctcatatcaacaaaccattcggtgtagacaggtttgtccggagaagccccgtcgcgcgccatcaccacgatgtacggggtgtaggcgctgctggtaataaaacacttactaccattaagataaatcttaccatttctacgggtataagtcgttttcaggctacccacgtcggagcccgcgcccggttcggtaatcgctgagttccacatctgcttaccggtgccgcggaaagccataattttgtcgatctgctcttgtgtgccttcgcgcaggaaggtgttgaacccgcccggcaactggtacagcacataggttggtgcccccagacgtcccagctccatccacacggcggcgagagtaacaaaccccgcgtccagaccaccgtgctcttcagggatcagcagactgtcgatacccatatccgccagtgctttgacaaaacgttccgggtagacgctgtcacggtcgcactcggcaaaataggcctcccagttttcgctggccatcagttcgcggataccggcgacaaacagttcctgctcatcatttaaattaaaatccatctttcaacctcttgatattttgggggttaattaatctttccagttctgtttcgcgtctttaataaaggagagcgtcaccataatgttgacgaagaacagcgggcatcctccggcgataatggcggtttgaatcggtttcaggccgccgagcgccagcagaacaataccgataatgccaaccagaattgaccaaccgatacgcaccagcagaggtggttcttcaccatcgcgtacttcgcggcaagtggacatcgccagggtataagagcaggcgttaaccagcgtaacggtggcaataaagcagaggatgaagaagccccacatggtggcggtgctgagtggcagagcggcccaggtttcaatgatggcgcgcgccacaccgtactgttcgatcagatttggaatgttgatgatgtttttatctatcaacagcagagtgttactaccgagtacagtccacaggatccaggttgacgctgtcagccccagcaccatgccgaagcacagttcacgcacagtacgaccacgggagatgcgggcgaggaagatactcatctggatagcataaatcacccaccatgcccagtagaacacggtccagccctgcgggaagccgcctttagcgatgggatcggtatagaacaacatgcgcggcagatacatcagcaacatccccaccgaatcggtgaagtagttcatgatgaagctggcaccgctgacaatgaacacccaacccagcatcaggaagctcaggtaactacgcacgtcactggcgatacgtacccctttttgcagaccgcaagcgacgcaaatggcgttgaggataatccagcaggtaatgatgatagcgtccagttgcagggtatgcggaatgccaaacaaccattgcatacactcggtcaccagcggcgtggcaaggcccagactggtacccatcgcgaagatcaaggcgacgagatagaagttgtcgacgatagtgccgaacaaccctttggcgtgtttttcacctaccagcggcaccagtgtcgagctggggcgaatcacttccattttgcggacaaagaagaagtaagcgaaggcgactgaaaggaagctgtaagtggcccacggcagaggtccccagtggaacaagctgtaagccagccccaactctttcgcccctgtcgagttcggttctaagccaaacggcggggtggagatgtagtagtagatctcaatcgatccccagaacagtacggcagcagacgtacaggaggcgaacatcataaagatccaactggcggtgctaaattctggcggttcgttacctaaacgctttttggcatacgggccaaacaccagccagaaccaaccgaaaagcatcaccaccatataccattcaaatgcccatccccatacattggtgacgtaactgaatacagcattaataacgacattcgctgcatccagatctctgactgtaagccaacaaagtatgccgacgattattaacggcggaaagaaaaccttcggttctattcccgtttttctcttttcattcttcatgagttaattccactgtgaaaacgaatatttattttgcgttcccgtttgttttatttttgttaacatttaatataattattattaacctcgtggacgcgttaatggctaactcataatgggtattcaataagctgtattctgtgattggtatcacatttttgtttcgggtgaatagagggcgttttttcgttaattttgattaataatcagtttgttatgctctgttgtgagtaaaaaataacatctgactttcaatattggtgatccataaaacaatattgaaaatttctttttgctacgccgtgttttcaatattggtgaggaacttaacaatattgaaagttggatttatctgcgtgtgacattttcaatattggtgattaaagttttatttcaaaattaaagggcgtgatatctgtaattaacaccaccgatatgaacgacgtttccttcatgatttctggagatgcaatgaagattattacttgctataagtgcgtgcctgatgaacaggatattgcggtcaataatgctgatggttcattagacttcagcaaagccgatgccaaaataagccaatacgatctcaacgctattgaagcggcttgccagctaaagcaacaggcagcagaggcgcaggtgacagccttaagtgtgggcggtaaagccctgaccaacgccaaagggcgtaaagatgtgctatcgcgcggcccggatgaactgattgtggtgattgatgaccagttcgagcaggcactgccgcaacaaacggcgagcgcactggctgcagccgcccagaaagcaggctttgatctgatcctctgtggcgatggttcttccgacctttatgcccagcaggttggtctgctggtgggcgaaatcctcaatattccggcagttaacggcgtcagcaaaattatctccctgacggcagataccctcaccgttgagcgcgaactggaagatgaaaccgaaaccttaagcattccgctgcctgcggttgttgctgtttccactgatatcaactccccacaaattccttcgatgaaagccattctcggcgcggcgaaaaagcccgtccaggtatggtcggcggcggatattggttttaacgcagaggcagcctggtcagaacaacaggttgccgcgccgaaacagcgcgaacgtcagcgcatcgtgattgaaggcgacggcgaagaacagatcgccgcatttgctgaaaatcttcgcaaagtcatttaattacaggggatgctatgaacacgttttctcaagtctgggtattcagcgataccccttctcgtctgccggaactgatgaacggtgcgcaggctttagctaatcaaatcaacacctttgtcctcaatgatgccgacggcgcacaggcaatccagctcggcgctaatcatgtctggaaattaaacggcaaaccggacgatcggatgatcgaagattacgccggtgtcatggctgacactattcgccagcacggcgcagacggcctggtgctgctgccaaacacccgtcgcggcaaattactggcggcaaaactgggttatcgccttaaagcggcggtgtctaacgatgccagcaccgtcagcgtacaggacggtaaagcgacagtgaaacacatggtttacggtggtctggcgattggcgaagaacgcattgccacgccgtatgcggtactgaccatcagcagcggcacgttcgatgcggctcagccagacgcgtcacgcactggcgaaacgcacaccgtggagtggcaggctccggctgtggcgattacccgcacggcaacccaggcgcgccagagcaacagcgtcgatctcgacaaagcccgtctggtggtcagcgtcggtcgcggtattggcagcaaagagaacattgcgctggcagaacagctttgcaaggcgataggtgcggagttggcctgttctcgtccggtggcggaaaacgaaaaatggatggagcacgaacgctatgtcggtatctccaacctgatgctgaaacctgaactgtacctggcggtggggatctccgggcagatccagcacatggttggcgctaacgcgtcgcaaaccattttcgccatcaataaagataaaaatgcgccgatcttccagtacgcggattacggcattgttggcgacgccgtgaagatccttccggcgctgaccgcagctttagcgcgttgatccactctggcagggctgcattttggccctgccgctgacagggagctcttatgtccgaagatatctttgacgccatcatcgtcggtgcagggcttgccggttcggttgccgcactggtgctcgcccgcgaaggtgcgcaagtgttagttatcgagcgtggcaattccgcaggtgccaagaacgtcaccggcgggcgtctctatgcccacagtctggaacacattattcctggtttcgccgactccgcccccgtagaacgcctgatcacccatgaaaaactcgcgtttatgacggaaaagtcagcgatgactatggactactgcaatggtgacgaaacctcgccatcccagcgttcttactccgttttgcgcagtaaatttgatgcctggctgatggagcaggccgaagaagcgggcgcgcagttaattaccgggatccgcgtcgataacctcgtacagcgcgatggcaaagtcgtcggtgtagaagccgatggcgatgtgattgaagcgaaaacggtgatccttgctgatggggtgaactccatccttgccgaaaaattggggatggcaaaacgcgtcaaaccgacggatgtggcggttggcgtgaaggaactgatcgagttaccgaagtcggttattgaagaccgttttcagttgcagggtaatcagggggcggcttgcctgtttgcgggatcacccaccgatggcctgatgggcggcggcttcctttataccaatgaaaacaccctgtcgctggggctggtttgtggtttgcatcatctgcatgacgcgaaaaaatcggtgccgcaaatgctggaagatttcaaacagcatccggccgttgcaccgctgatcgcgggcggcaagctggtggaatattccgctcacgtagtgccggaagcaggcatcaacatgctgccggagttggttggtgacggcgtattgattgccggtgatgccgccggaatgtgtatgaacctcggttttaccattcgcggtatggatctggcgattgccgccggggaagccgcagcaaaaaccgtgctttcagcgatgaaaagcgacgatttcagtaagcaaaaactggcggaatatcgtcagcatcttgagagtggtccgctgcgcgatatgcgtatgtaccagaaactaccggcgttccttgataacccacgcatgtttagcggctacccggagctggcggtgggtgtggcgcgtgacctgttcaccattgatggcagcgcgccggaactgatgcgcaagaaaatcctccgccacggcaagaaagtgggcttcatcaatctaatcaaggatggcatgaaaggagtgaccgttttatgacttctcccgtcaatgtggacgtcaaactgggcgtcaataaattcaatgtcgatgaagagcatccgcacattgttgtgaaggccgatgctgataaacaggcgctggagctgctggtgaaagcgtgccccgcaggtctgtacaagaagcaggatgacggcagtgtgcgcttcgattacgccggatgtctggagtgcggcacctgtcgcattctggggctggggtcggcgctggaacagtgggaatacccgcgcggcacctttggtgtggagttccgttacggctgatgttggtttgatacgtaacgccgcactgactctcattgcaaaaaacaggaataaccatgcaaccgtccagaaactttgacgatctcaaattctcctctattcaccgccgcattttgctgtggggaagcggtggtccgtttctggatggttatgtactggtaatgattggcgtggcgctggagcaactgacgccggcgctgaaactggacgctgactggattggcttgctgggcgcgggaacgctcgccgggctgttcgttggcacatcgctgtttggttatatttccgataaagtcggacggcgcaaaatgttcctcattgatatcatcgccatcggcgtgatatcggtggcgacgatgtttgtttcatcccccgtcgaactgttggtgatgcgggtacttatcggcattgtcatcggtgcagattatcccatcgccacctcaatgatcaccgagttctccagtacccgtcagcgggcgttttccatcagctttattgccgcgatgtggtatgtcggcgcgacctgtgccgatctggtcggctactggctttatgatgtggaaggcggctggcgctggatgctgggtagcgcggcgatcccctgtttgttgattttgattggtcgattcgaactgcctgaatctccccgctggttattacgcaaagggcgagtaaaagagtgcgaagagatgatgatcaaactgtttggcgaaccggtggctttcgatgaagagcagccgcagcaaacccgttttcgcgatctgtttaatcgccgccattttccttttgttctgtttgttgccgccatctggacctgccaggtgatcccaatgttcgccatttacacctttggcccgcaaatcgttggtttgttgggattgggggttggcaaaaacgcggcactagggaatgtggtgattagcctgttctttatgctcggctgtattccgccgatgctgtggttaaacactgccggacggcgtccattgttgattggcagctttgccatgatgacgctggcgctggcggttttggggctaatcccggatatggggatctggctggtagtgatggcctttgcggtgtatgcctttttctctggcgggccgggtaatttgcagtggctctatcctaatgaactcttcccgacagatatccgcgcctctgccgtgggcgtgattatgtccttaagtcgtattggcaccattgtttcgacctgggcactaccgatctttatcaataattacggtatcagtaacacgatgctaatgggggcgggtatctcgctgtttggcttgttgatttccgtagcgtttgccccggagactcgagggatgtcactggcgcagaccagcaatatgacgatccgcgggcagagaatggggtaaattgttcagatttctctcttttctgaatcaatattattgactataagccgcgtgaatatatgactacactttgtgggaaaacaaaggcgtaatcacgcgggctacctatgattcttataatttatgcgcatccgtatccgcatcattcccatgcgaataaacggatgcttgaacaggcaaggacgctggaaggcgtcgaaattcgctctctttatcaactctatcctgacttcaatatcgatattgccgccgagcaggaggcgctgtctcgcgccgatctgatcgtctggcagcatccgatgcagtggtacagcattcctccgctcctcaaactttggatcgataaagttttctcccacggctgggcttacggtcatggcggcacggcgctgcatggcaaacatttgctgtgggcggtgacgaccggcggcggggaaagccattttgaaattggtgcgcatccgggctttgatgtgctgtcgcagccgctacaggcgacggcaatctactgcgggctgaactggctgccaccgtttgccatgcactgcacctttatttgtgacgacgaaaccctcgaagggcaggcgcgtcactataagcaacgtctgctggaatggcaggaggcccatcatggatagccatacgctgattcaggcgctgatttatctcggttcggcagcgctgattgtacccattgcggtacgtcttggtctgggatcggtacttggctacctgatcgccggctgcattattggcccgtgggggctgcgactggtgaccgatgccgaatctattctgcactttgccgagattggggtggtgctgatgctgtttattatcggcctcgaactcgatccacaaaggctgtggaagctgcgtgcggcagtgttcggctgtggcgcattgcagatggtgatttgcggcggcctgctggggctgttctgcatgttacttgggctgcgctggcaggtcgcggaattgatcggcatgacgctggcgctctcctctacggcgattgccatgcaggcgatgaatgaacgcaatctgatggtgacgcaaatgggtcgcagtgcctttgcggtgctgctgttccaggatatcgcggcgatcccgctggtggcgatgattccgctactggcaacgagcagtgcctcgacgacgatgggcgcatttgctctctcggcgttaaaagtggcgggtgcgctggtgctggtggtattgctggggcgctatgtcacgcgtccggcgctgcgttttgtagcccgctctggcttgcgggaagtgtttagtgccgtggcgttattcctcgtgtttggctttggtttgctgctggaagaggtcggcttgtcgatggcgatgggcgcgtttctggcgggcgtactgctggcaagctcggaataccgtcatgcgctggagagcgatatcgaaccatttaaaggtttgctgttggggctgtttttcatcggtgttggcatgtcgatagactttggcacgctgcttgaaaacccattgcgcattgtcattttgctgctcggtttcctcatcatcaaaatcgccatgctgtggctgattgcccgaccgttgcaagtgccaaataaacagcgtcgttggtttgcggtgttgttagggcagggcagtgagtttgcctttgtggtatttggcgcggcgcagatggcgaatgtgctggagccggagtgggcgaaatcgctgaccctggcggtggcgctgtcgatggcagcaacgccgattctgctggtgatcctcaatcgccttgagcaatcttctactgaggaagcgcgtgaagccgatgagatcgacgaagaacagccgcgcgtgattatcgccggattcggtcgttttgggcagattaccggacgtttactgctctccagcggggtgaaaatggtggtactcgatcacgatccggaccatatcgaaaccttgcgtaaatttggtatgaaagtgttttatggcgatgccacgcggatggatttactggaatctgccggagcggcgaaagcggaagtgctgattaacgccatcgacgatccgcaaaccaacctgcaactgacagagatggtgaaagaacatttcccgcatttgcagattattgcccgcgcccgcgatgtcgaccactacattcgtttgcgtcaggcaggcgttgaaaagccggagcgtgaaaccttcgaaggtgcgctgaaaaccgggcgtctggcactggaaagtttaggtctggggccgtatgaagcgcgagaacgtgccgatgtgttccgccgctttaatattcagatggtggaagagatggcaatggttgagaacgacaccaaagcccgcgcggcggtctataaacgcaccagcgcgatgttaagtgagatcattaccgaggaccgcgaacatctgtcattaattcaacgacatggctggcagggaaccgaagaaggtaaacataccggcaacatggcggatgaaccggaaacgaaaccctcatcctaataaagagtgacgtaaatcacactttacagctaactgtttgtttttgtttcattgtaatgcggcgagtccagggagagagcgtggactcgccagcagaatataaaattttcctcaacatcatcctcgcaccagtcgacgacggtttacgctttacgtatagtggcgacaattttttttatcgggaaatctcaatgatcagtctgattgcggcgttagcggtagatcgcgttatcggcatggaaaacgccatgccgtggaacctgcctgccgatctcgcctggtttaaacgcaacaccttaaataaacccgtgattatgggccgccatacctgggaatcaatcggtcgtccgttgccaggacgcaaaaatattatcctcagcagtcaaccgggtacggacgatcgcgtaacgtgggtgaagtcggtggatgaagccatcgcggcgtgtggtgacgtaccagaaatcatggtgattggcggcggtcgcgtttatgaacagttcttgccaaaagcgcaaaaactgtatctgacgcatatcgacgcagaagtggaaggcgacacccatttcccggattacgagccggatgactgggaatcggtattcagcgaattccacgatgctgatgcgcagaactctcacagctattgctttgagattctggagcggcggtaattttgtatagaatttacggctagcgccggatgcgacgccggtcgcgtcttatccggccttcctatatcaggctgtgtttaagacgccgccgcttcgcccaaatccttatgccggttcgacggctggacaaaatactgtttatcttcccagcgcaggcaggttaatgtaccaccccagcagcagccggtatccagcgcgtatataccttccggcgtacctttgccctccagcgatgcccagtgaccaaaggcgatgctgtattcttcagcgacagggccaggaatcgcaaaccacggtttcagtggggcaggggcctcttccggcgattctttgctgtacatatccagttgaccgttcgggaagcaaaaacgcatacgggtaaaagcgttggtgataaaacgcagtcttcccagcccccgcaattccggtgaccagttatttggcatatcgccgtacatggcatcaagaaagaagggataggagtcactcgatagcaccgcttctacatcgcgtgcgcactctttggcggtctgcagatcccactgcggcgtgatccctgcgtgggccatcaccagctttttctcttcgtcgatttgcagcagaggctggcgccgcagccagttaagcagctcgtcggcatccggcgcttccagcagcggtgtcaggcgatctttcggtttattgcggctgatcccggcaaataccgccagcagatgcagatcgtgattgcccagcaccagacgtacgctgtcgcctaaggatttcacatagcgcagaacatccagcgaacccggcccgcgcgcgaccagatcgcccgtcagccagagggtatctttcccaggggtaaattctactttatgcagcaatgcgatcagttcatcgtaacaaccatgaacgtcgccaataaggtatgtcgccatattcttttaatgaatgagtgtgggaacggcgagtcggaatacgggaatgtcgatgctgaaagggacgccattttcatcgatcatttcgtagtgaccctgcatggtgcccagcggggtttcaatgattgcaccgctggtgtactggtactcttcgccaggcgcgataagtggctggacgccaaccactccttcgccctggacttcggtttcacggccattgccattggtgatcagccagtaacgccccaacaactgcactggcgctcgccccagattgcgtatggttacggtataagcaaaaacgtaacgttcattatcaggtgaagattgagcctcaatgtagacgctttgaacctgaatacacactcggggcgaattgatcatcgttaactctcctgcaaaggcgcgttctccgccagatagttcgccatctggcaatattgcgcgacagagatattttccgctcgcatcgccgggtcgatccccattcccgttaacacctcgacgctaaacaggttgccgaggctgttacgaatggttttacgacgctggttaaaggcttcggtggtgatgcggctcaacacacgaacatctttaaccgggtgaggcatcgttgcatgaggaaccaggcgcacgacggcggaatccactttgggtggtggtgtaaaggctgacggcggtacttccagtaccgggatcacattgcaatagtattgcgccatgacgcttaatcgaccatacgctttgctgttcggtcctgcaaccagacgattcaccacctctttttgcaacataaagtgcatgtcggcaatggcatcagtatagctaaacagatggaacatcaacggcgtggagatgttataaggcaggttgccgaaaacacgcagcggctgacccattttctcggccagttcaccaaagttaaaggtcatcgcatcctgctgataaatcgtcagtttcgggcctaagaatggatgcgtttgcagacgtgccgccagatcgcggtcaagttcgatgaccgtcagctggtccagacgttcgccgaccggttcggtcaatgccgccagaccggggccgatttcgaccatcgcctggcccttttgcgggttaatggcagacacaatactgtcgatcacgaactgatcgttgagaaagttttgcccgaagcgtttacgggctaagtggccctggtggactcgattattcattgggtgttaacaatcattttgatggcgagattaagcgccgtaataaaactgccgacatcggctttgccacgtcccgccagttcaagcgcggtgccgtggtccactgatgtgcgaataaagggcaggcccagcgtaatgttcacaccgcgcccgaagccctggtattttagcacgggaagaccctgatcgtggtacatcgccagcacggcgtcggcgttatcaagatatttcggctgaaacagggtatcggcaggcagcggcccgttgagtttcatcccctgcgcccgcagctcattgagcaccggaataatggtgtctatctcttccgtacccatatgaccgccttcgcccgcgtgcggattcagcccgcagaccagaatgcgcggttcggcaataccaaatttggtccgcaaatcgtgatgcaaaatagcaatcacttcgtgcaaaagtgcaggggtgatagcgtctgcgatatcgcgcagcggtaaatgcgtcgttgccagcgccacgcgaagttcttcggtcgccagcatcatcaccacctttttcgcctgcgaacgctcttcgaaaaactcggtatgaccggtaaaaggaatgccagcgtcgttaataacgcctttatgcaccggacctgtgatcagcgcggcaaattcgccgttcagacaaccatcgcacgctcgcgccagcgtttccaccacataatgcccattttcaaccgctaactgccccgcagtgacaggtgcacgtagcgcgacaggaagtagcgttaatgtgcccgcagtttgcggttgtgcaggggagttgggggaataagggcggagggtgagcggcaaaccgagcatcgctgcccggttggtaaggagagtggcatcggcacaaacaaccagttcgaccggccactcacgctgtgcaagctggacaactaagtccgggccaatcccggcgggctcgccgggagtgatcacaacacgttgggttttaaccattagttgctcaggattttaacgtaggcgctggcacgttgttcctgcatccagcttgctgcttcttccgagaacttacggttcatcagcatgcggtatgcacgatctttctgcgcagcgtcggttttatcgacattacgggtatccagcagttcgattaaatgccagccgaatgaagagtgaaccggtgcactcatttgacctttgttcaggcgagtcagggcgtcacggaaggccggatcgaaaatatctggtgtagcccagccgagatcgccgccctggttagcagagcctggatcctgagagaactctttcgctgcggcagcaaaagtcgttttaccactcttgatatcagcagcaatctgttccagtttcacacgggcctgttcgtcagtcatgatcggcgacggtttcagcagaatatggcgagcatgaacttcggtcaccgagatatttttgctttcgccgcgcaggtcgttaactttcagaatatggaagccaacgccggaacgaatcgggccaacaatgtcgcctttcttcgcggtgcttaatgcctgggcgaagatcccgggcaactcctgaatacggccccagcccatctggccgccgttcagcgcctgctggtcggcagaatgagcaatcgccagcttaccgaaatcagcgccgttacgcgcctgatcgacaatggcgcgcgcctggctttccgcttcgttcacctgatcagaggtcgggttttccggcagcgggatcaggatgtggctcaggttcagctcagtgctggcgtcgttttggttacccacctgctgcgccagggattcgacttcctgcggcaggatggtgatgcgacgacgcacctcgttgttacgcacttcagagataatcatctctttgcggatctggttacgataggtgttgtagttcagtccatcgtaagccagacggctgcgcatctgatccagcgtcatgttgttctgtttcgcgatgttagcaatcgcctgatccagctgctcatcggagattttcactcccattttctgccccatctgcaggatgatttgatccatgatcaaacgttccatgatttggtggcgcagcgtcgcgtcatcaggaagttgctgccttgcctgagcagcgttcagttttaccgactgcattaatccatcaacgtcgctttccagcacgacgccgttattgacgacggctgcgactttatcgactacctggggggcagcgaaactggtattcgcgatcatggcgataccgagaagcagcgttttccagttcttcatactttttccatttcaattaaccgcactgcggattacgtggtaaatcaacaaatcacaaagtgttttgatacggcagaatgttcgaacgcagcatctcttgcgtacccagaccgtagttggagctcaggccgcgaagttcgatgttaaagccgattgcgttgtcatataccgcatgttgtttatcgttatcccaaccgttcagcttccgctcgtaaccgacgcgaattgcatagcagcaggagctgtattgcacacctaacatagagtcggcttgcttgttagcattggtgtcgtagtagtaggccccaacaatggaccaacgatcggcaattggccagctggcgacagcacctacctgcgaaataccattcttatattgctcagcagtggaatagtacttaggcagcgtagcctgaatatattccgggctggcgtaacggtaattcagctgtaccagacggtcttcatcccgacggtattcaatgctggagttactggtcgctacgttatccagacgtgtatcgtactgaatcccgccacgcaatccccaacgctcggagatacgccagtaagtatcgcctgcccacaccagtgaacccgttttgtcgtcattctcccatgttatgttgtcatcgccagtgcgagactccgtgaaatagtagatttgaccaacggaaatattaaaacgttcaacggcagcatcatcatatatgcgagatgtgacaccggtcgtcacctggttagcggaggcaatacggtcaagaccgccgtaagtccggtcccggaacaggccagagtagtcagattgcagcagagacgagtcgtagttatagatgtcgctctgatcgcgatacggcacgtacaaatactgcgcgcgcggttccagcgtttgggtataacccggagccagcatttccatatcgcgttcaaagaccattttgccgtcaactttgaattgcggcattacgcggttaacggattcgtccagcttggtcgtgtttctggagttataccagtcaagattggtttgctgataatgggttgccagcaacttcgcttcggtattgatgctgccccagttattagagagcggcaaattgatggtcggttccaggtgaacacgggttgcttcaggcatgtcgtctctggtgttaacaaagtgcactgcctggccgtaaatacgcgtatcaaacggaccaacatcattctggtagtaattaacgtctaactgcggctctgccgagtagctactggtgttctgttcgctgaaaacctggaactgcttggttgaaacggtggcattgaagttttgcaccgcatagccaacgctgaatttttgcgttgcgtagccgtcagtactggaaccgtacttgttatcgaaatcattgaagtagctaggatcgctgaccttggtgtagtcgacgttgaaacgccacacctgatccatgaccccggagtggttccagtagaataaccaacgacgtgaactgtcatcgttcgggtgttcatcttcatagactttatctgaaggcagatagtccagttccatcaagccagcgcccgcctgggagaggtagcggaattcgttctcccacatgatgttgccacgacgatgcatataatgcggcgtgatggtggcatccatatttggcgcgatgttccagtaatatggcaggtagaactcaaagtagttggtggtggtgtacttggcgttcgggatcaagaaaccagagcgacgtttgtcacccaccggcaactgcaaataggggctataaaagatcggtaccggacccaccttaaagcgggcgttccagatctccgcaacttgttcttcgcggtcatgaataatttcgctacctaccacgctccaggtgtcagaacccggcagacaggaggtaaagctaccgttatccagaatggtatagcggttttcgccacgttgtttcatcaggtccgctttaccgcgaccctggcgacccaccatctggtaatcaccttcccagacgttggtatctttggtgttcagattcgcccagcctttcggccctttgaggatcacctggttatcgtcgtaatggacattaccgagcgcatcaacggtacgtaccggctccggttgtcctggtgcctctttttgatggagctgcacttcgtcggcctgcagacggctgttaccctgcatgatatccacgctgccagtaaacacggcgtcatccgggtagtcccctttcgcgtggtcagcattgatagtcacgggtaagtcattggtatcgccctgtaccagaggacggtcatagcttggcacgcccaacatgcactgtgaggcgaggtcggctgccagtccctgttgactataaagggcggtggcaatcatggtggccaggagagtggggatacgttttttcatacgttgattttattgttccatcatcggtaacgttgcgcgtgacaaacggtcagagactaacgtactcgtcatctctacgctagtgttaatcctgtccgaatagcgtcagtggtgttaggcacggcattgaatgacaggtatgataatgcaaattataggcgatgtcccacaattgaccgcagccggaaaacggtaaaagcacctttatattgtgggagatagccctgatatccgtgtgtcgatttggggaatatatgcagtattggggaaaaatcattggcgtggccgtggccttactgatgggcggcggcttttggggcgtagtgttaggcctgttaattggccatatgtttgataaagcccgtagccgtaaaatggcgtggttcgccaaccagcgtgagcgtcaggcgctgttttttgccaccacttttgaagtgatggggcatttaaccaaatccaaaggtcgcgtcacggaggctgatattcatatcgccagccagttgatggaccgaatgaatcttcatggcgcttcccgtactgcggcgcaaaatgcgttccgggtgggaaaatcagacaattacccgctgcgcgaaaagatgcgccagtttcgcagtgtctgctttggtcgttttgacttaattcgtatgtttctggagatccagattcaggcggcgtttgctgatggttcactgcacccgaatgaacgggcggtgctgtatgtcattgcagaagaattagggatctcccgcgctcagtttgaccagtttttgcgcatgatgcagggcggtgcacagtttggcggcggttatcagcagcaaactggcggtggtaactggcagcaagcgcagcgtggcccaacgctggaagatgcctgtaatgtgctgggcgtgaagccgacggatgatgcgaccaccatcaaacgtgcctaccgtaagctgatgagtgaacaccatcccgataagctggtggcgaaaggtttgccgcctgagatgatggagatggcgaagcagaaagcgcaggaaattcagcaggcatatgagctgataaagcagcagaaagggtttaaatgaccctgtaaatgatgctgagtaactgcccacgattaaaggtggccgccctggcggtcacttctttgagaaaaggcgtttactcagaatggtggacaggctcaatgcacggtttacgggaggggttctgtaggttttatcgcgttgaccctgcttaaggttgagagctttacgacgagcggaattatatttttacgtcttaaaaataaaaaacacatacctgaatgagcgatttttgaaagtatatttattcagaacgcgcatcatgagtttttaactcaatgcgaggctattaccatgaaagtatcagttccaggcatgccggttacacttttaaatatgagcaagaacgatatttataagatggtgagcggggacaagatggacgtgaagatgaatatctttcaacgcttgtgggagacgttacgccatctgttctggtcagataaacagactgaggcttataaacttctgttcaatttcgtgaataaccagactggcaacatcaacgcctcagaatactttactggggctatcaacgagaatgagagagaaaagtttatcaatagcctggaattattcaataaacttaaaacatgcgcaaaaaatccggatgagttggtcgcaaagggcaatatgcgctgggtcgcccagaccttcggggatatcgagttaagtgtcacttttttcattgaaaagaataagatatgtactcagacgttgcagctgcataagggccaaggtaacttgggcgttgatcttagaaaggcttaccttcccggcgttgacatgagggattgttaccttggtaaaaaaacaatgaaaggtagcaatgatatcctttatgagagacctgggtggaatgctaacctgggcgtgctaccccggacggtgctaccccggacggtgctaacccggacggtgctaacctggacggtgctaccgtgaacggtgctacctccttatatgatgaggtaattattattaataaaatcccccccaaaaaaattgatactaaaggagttgctactgaagaagttgctactaaaaaagtactgctgaacaaattactgacaacgcaattattgaatgagccagaataagctaaggttgaaggggctggaacgccccttcaaccttagcagtagcgtgggatgatttcacaattagaaagacctgcatgatgagctagagaagaggctagtgacgcaaggcgtcgtgcaggacacggatcaccgagatgggcatcgccaaccagactgctaattagcccatgaataacaatcagaaaggaccataacagacccgttaaaatgaaatataagagacggtcaacgggtgaagaaaaagttcaaaaattcgctgtggagcaggaagggaattaccgaatggaaagcgtagccacacgcaacaactgaaagcagtttggcagaaacaaaaaatccccggactcggggatttatgtacaagaggcagcccttaggatgagggtataaacgtacaggaaaggttaaaaatccgctggcgctttaaacgtcatactattgccatacgccggatgggtaatcgtcaacatctctgcatgtagcaacaaacgtggtgccatcgctctcgcttctggtgatgcataaaaacgatcgccgagaatcggatgacccagcgccagcatatgcacacgcaattgatgcgaacgcccggtaatcggttttaacaccactcttgccgtgttatccgccgcatactccaccacttcatattccgtctgcgcaggtttacccgtttcgtaacagactttctgtttcgggcggtttggccagtcgcaaatcagcggcagatccaccagaccttctgcgggggatggatgcccccagacgcgggccacatactgctttttcggctcgcgctcgcggaactggcgttttaactcccgctccgcggctttggtcagcgccactacaatcacgccgctggtagccatatccagacgatgcaccgattctgcctgcggataatcacgctgaatgcgcgtcatcacgctgtctttgtgctcttccagacgacccggcactgacaacaaaccgctcggcttgttgaccaccataatatggtcatcctgatacaggataaccaaccagggttcctgcggtggattgtagttttccatccccattttcggctccgttactgatgcgttacaacgatcaaacgcagggcatccagacgccaacctgcctgatccaggctttccattacctgctgacggttgctctcaatggcggtcagttcgtcgtcacgaatgttcgggttcactgcacgcagagcttccagacgagacagctcggcagacagtttttcgtcggcttcgttacgcgctgcatcaatcaatgcacgggcagatttctcgatctgcgcttcacccagttgaaggatagcgtgaacatcctgctgcacggcgttaaccagtttgctgccggtgtgacggttaaccgcgttaagctggcggttaaaggtttcaaactctacctgcgccgccaggttgttgccgtttttatccagcagcatacgtaccggcgtcggtggcaggaagcggttgagctgcaactgcttcggagcctgggcttcaaccacataaatcagttccaccaacagcgtacctaccggcaacgctttgttttttaacagtgaaatcgtgctgctaccggtatcgccagaaaggatcagatccagaccgttgcggatcagcggatgctcccaggtaataaactgtgcatcttcacgcgccagcgccacttcacgatcaaaggtgatggtgatgccatcttccgacaggccagggaagtccggcaccagcatatgatcggacggcgtcagcacgatcatgttgtcgccgcgatcgtcctgattgataccgataatatcgaacaggttcatggcgaaggcgatcaggttggtatcgtcatcctgctcttcaatgctttctgccagtgcctgggctttttcgccaccgttggagtggatttccagcaggcggtcacgaccctgttccagctgtgctttcagcgcttcatgttgctcgcggcagtttttgatcagatcgtcaaagccttcggtttgatccggtgaagccagatagttaatcagatcgttgtatacgctatcgtaaatagtgcgtccggtcgggcaggtgtgctcaaatgcatccagaccttcgtgataccagcgcaccagcaccgactgagcggttttctccagataaggcacatggatctgaatatcgtgcgcctggccgatacgatccagacgaccaatacgctgctccagtagatccgggttgaatggcaggtcaaacatcaccatgtggctggcgaactggaagttacgtccttcagaaccgatttctgagcacagcagtacctgtgcgccggtgtcttcttcggcaaaccaggcggcagcgcggtcacgttcgataatcgacataccttcgtggaacaccgcagcgcgaataccttcacgttcgcgcagtacctgctccagttgcagcgcagtggcagctttggcgcagatcaccagcactttctgagagcgatggctggtcaggtagcccatcagccactcaacgcgcggatcgaagttccaccaggtggcgttatcaccttcaaattcctgataaatacgctccgggtagagcatatcgcgagcacgatcttccgcacttttacgtgcgcccataatgccggagactttaatagccgtctgatactgcgtcggtagcggcagcttaatggtgtgcagctcgcgtttcgggaatcctttcacaccgttacgcgtgttacggaacagcacgcggctggtgccgtggcgatccatcagcatcgaaaccagctcctgacgggcgctctgggcatcttcgctgtcgctgtttgctgcctgcaacagcggctcgatatcctgctcgccgatcatctcgccgagcatgttcagttcgtcattgctcagtttgttacctgccagcagcatggcaacggcgtccgcaaccggacgataatttttctgctcttcaacgaactgcgcaaaatcgtggaaacggttcgggtccagcagacgcagacgggcgaagtggctttccatccccagctgttccggggtcgcggtcagcagcagaacgcccggcacgtgctctgccagttgttcaatggcctgatattcacggcttggcgcatcttcgctccacaccaggtgatgcgcttcatcgaccaccagcaggtcccattcggcttcacagagatgttccaggcgctgtttgctacgacgggcaaaatccagcgagcaaatcaccagctgttcggtgtcaaacgggttgtaagcatcgtgctgagcttcggcataacgctcatcatcaaatagcgcaaagcgcaggttgaaacggcgcagcatttctaccagccactgatgctgtaaggtttccgggacgataattagcacacgttcagcagcgccagagagcagttgctgatgcaggatcatcccggcttcaatggttttccctaaacccacttcgtcagccagcaggacgcgcggcgcgtggcggcgaccaacatcatgagcgatgttgagctgatgcgggatcaggctggtacgctgaccgcgcaggccgctgtacggcatacggaactgttcgctggaatatttacgcgcgcgataacgcagcgcaaagcggtccatacggtcaatctgcccggcaaacagacggtcctgcggtttgctgaacaccagtttgctatcaaggaaaacttcacgcagggctacgccggactcttcagtatccaggcgagtaccgatataggtcagcaagccattttcttcttttacttcttcgacttgcatctgccagccgtcatggctggtaatggtatcaccagggttgaacatcacgcgggtcacgggggaatcactgcgtgcgtacagacggttttcaccagtagatgggaaaagtaaagtgacagttcgcgcatccaccgcgacaacggttccaagtcccaattcgctttctgtatcgctgatccagcgttgaccaagtgtaaaaggcatatgtgttcggctctatatctttaattgcaggcaataaccacccgctaccgtgcttatgaggtagtggtgttattcaggtccaggaatggaaagggcgctatggtactggatggcaaagcattcgtcacgcatcaaaatggtatctggcgaactcttttttttgctcaaaatagcccaagttgcccggtcataagtgtagcaaaattatcctcaataaaagggagtattccctccgccacgggttgtagctggcgggtcagatagtgttcgtaatccagtggtgaacgttggtagtccagcggctccgggccgttggtggtccatacgtacttaatggtgccgcgattctgatattgcaaggggcgaccacgcttttggttttcttcatcggcaaggcgagcggcgcgtacatgaggcggcacattacgctgatactcgctcagcggacggcgaaggcgtttacggtaaaccagtcgcgcatccagttcacccgccatcagtttgtcgatggtttcgcgtacatattcctgatatggctcgttgcggaagatgcgcaggtatagctcctgctgaaactgctgggccagcggcgtccagtcggtgcgcacggtttccagccctttaaacaccatccgctgcttgtcgccctcctgaatcagtccggcataacgctttttactgccggtatcggctccgcgaatggttggcatcagaaaacggcagaaatgggtttcatactccagttctaatgcgctggtcagccgttgtttttgcagcgtttccgcccaccaggcgttaacgtgctgcaccagtgcacgaccgattttcgccgcttcttcttccgaatgtgcgcctttcagccagacaaacgttgagtcggtatcgccgtagataacgtcgtagccctgtgcttcaatcaacgctttggtttgccgcatgatctgatgaccacgcatggtgatcgacgatgccagccgcggatcgaagaagcggcaggcggtggtgccgagcacgccataaaaggcattcatgatgattttcagcgcctgcgacagcggtttgttaccctggcgtttggcttcatcgcgcccgtgccagatgttagtcacaatctccggcaggcaatgtttttctcgcgagaaccaggcatcgagaaaaccttcggtactgtgctctggatcaggctgcgccatgccttccaccagcccgacgggatcaatcagaaaggtgcggatgatcgacgggtacaggcttttatagtccagcaccagcactgaatcataaagccctggccgtgaatccatcacgtagccgccagggctggcgtgcggcggcacttcgccgagattaggcgcgacataaccagcgcgatgcattcgcggaaaatagagatgaccaaatgccgccaccgaaccgccgtgtcggtccaccggcaggccgttcaccgttgcccgttcgagtaaaaatggcatgatttcagttttgtggaagatctgcgtcaccagctcgcaatctttcaggttataagttgccagcgcaggtttatcttcggcgaaacggcggtcaatttcgtccattcgatcccacgggttatcgatagattttccttcgcctaatagctcctgagcgacagtttccagcgagaatgaagagaaattccagaacgcggatttcagcgcctcgataccgtcgataattagccgacctttagcctgggcaaaaaagacgccgtttttaaagccgtgctcgcgccactccagctcgctattatcgcgcccaagacgcagcggaagacggtaacgctcggcatgtttttgcagcattcgcagatcgaactgcaccacgttccaaccgatgatcacatcaggatcgtagttggcaaaccaggcgttgagtttttccagcaactgcgggcggctggcgacgtattccagttcgaaatcaagcgaggaggcgtcgccattctccggccccagcatataaacgatgcgctgcccgcagccttccaggccgatgcagtacagctcaccgtggcgggtggtttcaatatctatagaaacccacttgagcggcggacgatagtcgggatgcggtttcagacgggcattaacgatagtgccattgtgcatatcaccctcgacccacaccggtgaggtgataaaccgctccatcagatagcgttctggcggacgcacatcggcctcgtagacggtaacgccaccttcacgcaggcgcttttcgtaattcatcaattggcgatgggcgcgacagtaaaggccatacaccggctggcggtgaaaatcctttaacgccagcggtgtcaggcgaaagccttgttcaccctgcaaaatatgctgagcgcggggaacctgatcggcgggaataaacgccacggactcttgcggtgcaagcgtaacctgcaacggcccgttgtccgtcgccagccagaaggagacttctgtcccttgcggggtgtcccgccagtgtcgggttaagataaaacctgcctgcgccacgctgaaaatccatcaaaaaaccaggcttgagtatagcctggtttcgtttgattggctgtggttttatacagtcattactgcccgtaatatgccttcgcgccatgcttacgcagatagtgtttatccagcagcgtttgctgcatatccggtaactgcggcgctaactgacggcagaatatccccatataagcgacctcttccagcacgatggcgttatgcaccgcatcttcggcatttttgccccatgcaaacgggccgtgggaatggaccagaacgccgggcatttgcgctgcatcgataccctgtttttcaaaggtttctacgatgacgttaccggtttcccactcatattcgccgttgatttctgcgtcggtcattttgcgggtgcagggaatggtgccgtagaaatagtcggcgtgggtggtgccggttgctggaatcgactgacccgcctgcgcccagatggtggcgtggcgcgagtgcgtatgcacaatgccgccaatggaggggaatgcctgatagagcagccggtgagttggcgtgtcggaggagggctttttcgtaccttcaaccacttcaccggtttcgatgctaaccacgaccatatcgtcagcggtcatgacgctgtaatcgacgccggaaggtttgatcacaaagacgccgcgctcgcgatcaacggcgctgacgttgccccatgtgagcgtgaccaggttgtgttttggcagcgccaggttggcttctaatacctggcgtttgagatcttctaacatgttgactccttcgtgccggatgcgctttgcttatccggcctacaaaatcgcagcgtgtaggcctgataagacgcgccagcgtcgcatcaggcgttgaatgccggatgcgctttgcttatccggcctacaaaatcgcagcgcgtaggcctgataagacgcgccagcgtcgcatcaggcgttgaatgccggatgcgctttgcttatccggcctacaaaatcgcagcgtgtaggccagataagacgcgtcagcgtcgcatcaggcgttacataccggatgcggctacttagcgacgaaacccgtaatacacttcgttccagcgcagcgcgtctttaaacgctggcaggcgtgtgtcgttatcaatcaccgtgatttcaatgtcgtgcatctcggcgaattggcgcatatcgttgaggttcagtgcatggctgaagacggtatggtgcgcgccaccagcgaggatccacgcttcggaagcagttggcagatccggttgcgctttccacagcgcattcgccaccggcagtttcggcagggagtgcggtgttttcaccgtgtcgatgcagttaaccagtagacggtaacgatcgccgagatcaatcaagctggcgacaatcgctgggccggtttgggtattgaagatcaggcgggcaggatcgtccttaccaccaataccgagatgctgaacgtcgaggatcggtttctcttctgcggcgatcgacgggcagacttccagcatatgggagccgagcaccaggtcattacctttctcgaagtgataggtgtagtcctccataaaggaggtgccgccctgcagaccggttgacatcaccttcatgatgcgaagcagggcggcagttttccagtcgccttcgcccgcaaagccgtaaccctgctgcatcagacgctgtacggccagaccaggaagctgtttcagaccgtgcaaatcttcaaaggtggtggtgaacgcgtggaagccaccttgttccaggaaacgcttcatccccagctcaatacgcgccgcttccagcacgttctgtcgttttttgccgtggatttgtgtggcaggcgtcatggtgtagcagctttcgtactcatcgaccagcgcgttaacatcgccgtcgctgatggagttcaccacctgcaccagatcgccaaccgcccaggtattgacggagaaaccgaacttgatctgtgcggcaactttatcgccatcggtgaccgccacttcacgcatgttatcgccaaatcggcagactttcagatgacgggtatcctgtttagagaccgcctgacgcatccaggagccgatacgctcatgggcttgtttatcctgccagtgaccggtaaccacggcatgttgctgacgcatacgcgcgccaatgaagccgaactcgcgaccgccatgtgcagtctggttcaggttcataaagtccatatcgatactgtcccacggcagcgccgcgttgaactgggtgtggaattgcagcaacggtttgttgagcatggtcaggccgttgatccacattttggccggggagaaggtgtgcagccacaccaccagaccagcgcaacgatcgtcgtaattcgcgtcgcggcaaatagcggtgatttcatccggcgtggtgcccagcggtttcaacaccagtttgcagggcagtttcgcttccgtattcagcgcattaacgacgtgctcggcatgttgggtgacctgacgcagggtttccgggccatacagatgctggctgccaatgacaaaccacacttcataattatcaaaaatcgtcattatcgtgtccttatagagtcgcaacggcctgggcagcctgtgccggggcggaagttggaagatagtgttgttcggcgctcatcgcccattgctgatagcggcgataaagctgttcaaagcgttgtgcctgctcgctgcacggttgcagggttttctctaccgcactggccattttttgctgagctgatgggatgtctgcgtgcactttcgcggcgacggcagcaaaaatcgccgcaccgagcgcacagcactggtcagaggcaacaatttgcagcgggcgattcagcacgtcgcagcaggcctgcataatgacctggtttttccgcgcgatgccgcccagtgccatcacgttattaacggcgatcccctgatcggtaaagcactccatgattgcgcgtgcgccaaaggcggtggcagcaatcaaaccgccgaacagcagcggagcgtcggtagcgaggttaagatcggtaatcacccctttcaggcgttggttagcgttcggtgtgcggcggccgttaaaccagtcgagcaccaccggcaggtgatccagagacggatttttggcccatgcttcggtcagcgccggaagcagttgtttctggctggcgttgatttgcgttttcagttccggatgctgggcggcaagctgttccagcggccagccgagtacgcgaccaaaccaggcgtagatatcaccaaacgccgattggcctgcttccagaccgataaatccaggcaccacgctgccatcaacctgaccgcaaatacctttaactgcccgctcgccaacgctctgtttgtcggcaatcagaatgtcgcaggtggaagtaccgataacttttaccagtgcgttaggctgtgcgcctgcgccaactgcgcccatatggcagtcaaacgcgccgccggaaatcaccacgctttcaggcaggccgagacgctgcgcccattccgggcataaggtgcccaccggaatatcggcagtccaagtgtcagtgaacagcggggaaggcaaatggcgattgaggatcgggtccagctcatcaaagaaactggctggcggcaggccgccccagctttcgtgccacagagatttatgcccggcgctgcaacgtccgcgacgaatatcctgcgggcgggtggtaccggaaagcagagctggcacccagtcgcacagctcaatccacgatgcggcagattgcgccacggcgctgtcctggcgagtcacatgcaggatttttgcccagaaccattcgctggaataaataccaccaatgtagcgggagtagtcaacgttgcccggcgcgtggcacaaacgggtaatctcttccgcttcttcaaccgcagtgtggtctttccacaatacgaacatcgcgttcgggttttcggcaaactccgggcgcagcgccagcacgtttccgtcggcatcaatcggtgcgggcgtcgagccggtactgtcaacgccaatcccgaccacagctgcgcgctgttcgacgctaagctctgcaagcacggttttcagtgccgcttccattgactcaatgtagtcacgcggatgatgacggaactggttattcggggcatcacaaaattgccctttctgccaacggggataccactctacgctggtggcgatctcttcaccggtagcgcagtccaccgccaaagctcgcacagaatcactgccaaaatcgaggccaattgcaatcgccatcgtttcactccatccaaaaaaacgggtatggagaaacagtagagagttgcgataaaaagcgtcaggtaggatccgctaatcttatggataaaaatgctatggcatagcaaagtgtgacgccgtgcaaataatcaatgtggacttttctgccgtgattatagacacttttgttacgcgtttttgtcatggctttggtcccgctttgttacagaatgcttttaataagcggggttaccggttgggttagcgagaagagccagtaaaagacgcagtgacggcaatgtctgatgcaatatggacaattggtttcttctctgaatggtgggagtatgaaaagtatggctgaagcgcaaaatgatcccctgctgccgggatactcgtttaacgcccatctggtggcgggtttaacgccgattgaggccaacggttatctcgatttttttatcgaccgaccgctgggaatgaaaggttatattctcaatctcaccattcgcggtcagggggtggtgaaaaatcagggacgagaatttgtctgccgaccgggtgatattttgctgttcccgccaggagagattcatcactacggtcgtcatccggaggctcgcgaatggtatcaccagtgggtttactttcgtccgcgcgcctactggcatgaatggcttaactggccgtcaatatttgccaatacgggtttctttcgcccggatgaagcgcaccagccgcatttcagcgacctgtttgggcaaatcattaacgccgggcaaggggaagggcgctattcggagctgctggcgataaatctgcttgagcaattgttactgcggcgcatggaagcgattaacgagtcgctccatccaccgatggataatcgggtacgcgaggcttgtcagtacatcagcgatcacctggcagacagcaattttgatatcgccagcgtcgcacagcatgtttgcttgtcgccgtcgcgtctgtcacatcttttccgccagcagttagggattagcgtcttaagctggcgcgaggaccaacgcattagtcaggcgaagctgcttttgagcactacccggatgcctatcgccaccgtcggtcgcaatgttggttttgacgatcaactctatttctcgcgagtatttaaaaaatgcaccggggccagcccgagcgagtttcgtgccggttgtgaagaaaaagtgaatgatgtagccgtcaagttgtcataattggtaacgaatcagacaattgacggcttgacggagtagcatagggtttgcagaatccctgcttcgtccatttgacaggcacattatgcaagcattgctggaacactttattacccaatccaccgtgtattcattgatggcggtggtgttggtggcctttctggagtcgctggcgctggtcggtttgattctacccggtacggtgctgatggcggggctgggagcgctgattggcagcggcgagttaagtttctggcacgcctggctggcagggattattggctgcttgatgggcgactggatttctttctggctgggttggcgttttaaaaagccgttgcatcgctggtcatttctgaagaaaaacaaagcactacttgataaaactgaacatgcgttgcatcaacacagcatgttcaccattctggtcggtcgttttgttggcccgacgcgtccgctggtgccaatggtggcgggaatgctggatctgccggtggctaaatttattacgccgaatattatcggctgcctgctgtggccgccgttttacttcctgccagggattctggcgggcgcggcgatcgatattcctgccggaatgcagagcggtgagtttaaatggttgctgctggcaacagcggtgtttttgtgggttggtggctggctgtgctggcggttatggcgcagcggtaaagcgactgaccgtttgagtcattatttgtcccgcggtcgtttgttgtggctgacgccgttgatttctgccatcggcgtggtggcgctggtggtgttaattcgccacccgttgatgccggtgtatatcgatattttgcgtaaagtggttggggtttaggagatagtcttgtgcgggttgcctgatgcgacgcttgccgcgtcttatcaggcctacaaaacgcactacccgtaggtcggataaggcgttcacgccgcatccgacagtgcatactaacccgtaatccccaatagtgccgaagcactcgccttaccgctcaacaactcattggtcataccctgccaggcgatgcgcccgtcggcgactactaccgagcgcgtggcgatccgcgccgcatcttccacgctgtgcgacaccatcaatagcgtcattttttgctgctggcagctcgtgctcaccagcgtcaacatctcctgacgtaacgccggatcgagcgcagagaacggttcatcgagcaataaaatcggctgttcgcgtaccagacaacgcgctaacgccactcgctgtcgctgaccgccggaaagctcgcccggtaaccgcgccattaaattatcaatccccatctggcgggcgatagcgtgcattttcccctgctgtaccgcgttcagtttcaatcccggatttagccccagcccgatgttctgtgcgaccgtcaggtggctgaacaggttgttctcctgaaacagcatcgacaccggacggcgtgacggcggcatagttgtgtgatctacgccatcgatagtcagcgaaccgctggctggcgtcagaaaaccggcgatcaaattcagcagggtacttttacccgcgccgcttggcccgaggatcgccacctgctcgccgcgttccaccgttaagctaaaacgcatcggcaaatggtggtaaagccaggtgatatcagtcagttttaacatttcgccccggtagtttttcaatcacggtaaacagcagaaaacagagcagcagcagaattaacgcggtgaccgcaccgtcctggctgcgataggagccaatttgctggtagagataaaacggcagggtgcggaaatcatcgttaccgaacaacgccaccacgccaaaatcaccaatcgacagcacgcatgcaaaggccagcgcctgcgccagtggacgtttcagggcgcgcagctccaccacttttaagcgtgaccagccttcaatccccagcgactgacataacatgctgtagcgggcggtgatatcgcgcatcgggttttccagcactttcagcgcataagggatcgccattaacgcattggtgaaaatcacaatgccgtcagcagattgtggcaggccgatagtgttgttgagcagtaaaaagaagccggtagccagcacaatccccggcatggcgaggatcaacatgccgctcatctccagcacctgacccgccagcattttctgccgcgcccgcagttcgcgactgctccatagcagcatcatggtcagcactacgcacaatacacctgccgccagcgcaatacgcaacgaggtccacagcgcctgccacagcaccggttgtgccagcacttccggcaactggcgatttaccccatcgacgatcaccgccagtaacggtggcagcaacagcagcagcgccagcacaattaacaccgtgtcgcaaatgcggctatgcagacgatcgtccgggtcgcgccagccttgcagcagcgtggtgccgggcgcaatggccttactcaatcgctgactcaacagcaccagcccgaggcagcacaccatctggagcagcgccagcattgccgcgcgggcaggatcgtagtcgtaactcagcgcctgatagattgccagctcgatagtggtcgcctgcggaccgccccccagcgatagcacggtggcgaagctggcgaaacagagcataaagataagcgcagcaaccggcgggatttgtcgccgtaaccacggccattcgacgaagcggaaaaaatgccagctacgcatcccaagctgggcggcaagttgacgctgttcgccggggatgttttccagtgcctggagtaataagcggctcgccatcggcagattaaaaaacacatgggccagcaaaataccttgcaggccgtagggcgaaaaggtccactccagaccgagcgattggcagagtgttgccagccagccctggcgaccatagacgctaagaatgccgaaaacagcgaccaacaccgggaggatcaaggtcattgcacacagacgcaacagcgccagccgacccggaaagcgcctgcgatagagcgcgcgggcgaggaatatcgcgggtatgacagagagcagtgccgagagaaacgcctgccagaaggagaagcgcaccacatgccacagatagctgtcctgccagactgccacccagtcatcctgcggcgcgttccaccacagggcgagaaacgccgccagcgcaaccgctaccaccagcgtggtggcgcttacacctggaattaaccagccgggaattaacggctgacggcgcgttgccattcgctaatccatgcctgacgttgtgccgccacttcggctggcgtgaactccaacgtggttgcgggtttggtcaatttttcaaaaccggcaggcagcgtgacgtttgccaccggatacatccagttgccggttgggatcgcattctggaaagccggagaaaccataaactggaggaatttttgcgccagctccggctgcttgctggcagcggtgcgggcggcgacttccacttgcagatagtgaccttcgctgaagttcgcggcggcgtagttatctttcttctcttcgagaatgtgataagccggagaggtggtgtaactcagtaccagatcgctttcaccttttaaaaacaggccgtaggcttcgctccagcctttggtgaccgtgaccgttttcttcgccagtttctgccaggcttgtggggcgtcatcgccatagactttttgcatccatagcaacagacccagccccggtgtactggtgcgcggatcctgataaatcacccgccagttttgatcgctctcaaccagttctttcaggctttgtggcgggtttttcagtttgttcttgtcataaacgaaggcgaagtagccataatcaaacggtacgaaagtgtcattattccagccgccgggaacgttaacggcatccgctgccacaccgcttttggcaaacagtccggttttactggcggcgtctaacaggttgttatccagccccagcaccacatcggctttactgtttttgccttccatccgtagacggttgagaagcgaaacgccatcttccagcgccaccagtttcagttcgcaattacagtcggcttcaaaggcttttttaaccaccggaccaggcccccagtcggcggcgaaggaatcgtaggtataaacagtcagaacgggtttagcgaaaacgggcgctgtgcacagcaacagcaggggcagacatttttttaacactttgcacctcaaaaaagagtggcaaaggacttgagaaggagcctcaaatcccttcgccggcgttatccggatcaggttcgacgggtattttctcagcgcacgcgtacgcgtggcaccccgttgagaacggcgttagtgtagtgattttgttatcaaccagcaatcatggatccggtggcgcaaaccacgctgatttaaaatcgaaccagccgagggtattcatgcgcaggccgcgcatactgcgttgcccctgaatgatcagccagtggtgcaataatggcaccatcgctttgctggcgaccagttgctggcaccagttcgccagattcatctcgccattgcgccagcgagcagcgtcggcttgccagtcaatgggaatgcaatgttgtagcagtggcacttcgcataaatgtgcgaaaacagagaagtccagcggcagggtaaagttggcgctgtttagccagatatcactttcgatctctcctgtatgccactgatcgtagtcgatctctttgattttcagcgtgacctggtgacttgccagaatctgctgcatgatcccggcaatcacccgatgctcactgtgatcctgataaaaggttagggtgaggctttccaggccagccggtttttcgctctttatggtgcgggcatggtgccaacgggggagcagtccataagccgggaaccacagttgctggtactgttcctcagcgaaatagaccagattagttggagaaagcacatagcttacccagtccctgacttgctgattcgccccgcgatgggtgcggctgtcgaacagtaaatagtagcaaccttcctccaggcggctttcaatctctttttcctcgccctgtggaccttttagcatcagccctccggctggctcgtcggcaatttccggcagaacccagacgttaacttcgtcgattaatgcccggtaaccgaagaagtcatcgaatgcctgaattttcagttgattggtgctgttgcgaatcaccgcatacggaccggtgccgatgggatggctggcaaagttactgagggtttcccattcgcgcggcaggatcatcgccggaacttgccccagcagtaacggtaaccagcggtccggttgcgtgagatggatatccagcgtccagggcgtcggcgacacaatgtcagcaatatgcgaatagagcggcagcgtattgattcgttttaaagaggcgatcacatcgtccatttccagttcacgaccatggtgaaaatggactcctggacgcaaaaagaaacgccagtgaagcggtgaaatttgctgccagtggtgggcgatgtctgcttccagttccccattttcctcatttatgcgcgttagcgaactgaagatttgccgggcgatatgggtttcggaacggcgcaatgcgctgccaggtagcagattacgcaacggacgatagtagagcacgcgcaggatgtgccgcccctggcggaagctgcggcccagatgagaaaccagcatttgccgcacagtcgctttgtcgccaaccaactgcaccagttgatcgatacgatcctgctccagcaggtcttccgcccgctgttgctgaagcgccagcccggtatagaggaatgtcagacgcgagcgtttaccgcgcccgacttccgcttcccacgtcagccagccgcgatcctgcatggtgttgagcagggtgcgcatatgacgacgcgagcagctcaataacgctgccagttcgttgagcgttgtgtcctgcgatttaccctcgcagcattgccacaggcggatgaactgttgttgcagacgagcagatggcataaaaggggaactcctgtgcaaaagacagcaattttattttccctatattaagtcaataattcctaacgatgaagcaagggggtgccccatgcgtcagttttatcagcactattttaccgcgacagcgaagttgtgctggttgcgttggttaagcgtcccacaacgattaaccatgcttgaaggactgatgcagtgggatgaccgcaattctgaaagttgacttgcctgcatcatgtgtgactgagtattggtgtaaaatcacccgccagcagattatacctgctggttttttttattctcgccgcgctaaaaagggaacgtatgatctggataatgacgatggctcgccgtatgaacggtgtttacgcggcatttatgctggtcgcttttatgatgggggtggccggggcgctacaggctcctacattgagcttatttctgagtcgtgaggttggcgcgcaacctttctggatcggcctcttttatacggtgaatgctattgctgggatcggcgtaagcctctggttggcaaaacgttctgacagtcagggcgatcggcgaaaactgattatattttgctgtttgatggctatcggcaatgcgctattgtttgcatttaatcgtcattatctgacgcttatcacctgtggtgtgcttctggcatctctggccaatacggcaatgccacagttatttgctctggcgcgggaatatgcggataactcggcgcgagaagtggtgatgtttagctcggtgatgcgtgcgcagctttctctggcatgggttatcggtccaccgttggcctttatgctggcgttgaattacggctttacggtgatgttttcgattgccgccgggatattcacactcagtctggtattgattgcatttatgcttccgtctgtggcgcgggtagaactgccgtcggaaaatgctttatcaatgcaaggtggctggcaggatagtaacgtacggatgttatttgtcgcctcgacgttaatgtggacctgcaacaccatgtacattattgatatgccgttgtggatcagtagcgagttaggattgccagacaaactggcgggtttcctgatggggacggcagctggactggaaataccagcaatgattctggctggctactatgtcaaacgttatggtaagcggcgaatgatggtcatagcagtggcggcaggagtactgttttacaccggattgattttctttaatagccgtatggcgttgatgacgctgcaactttttaacgctgtatttatcggcattgttgcgggtattgggatgctatggtttcaggatttaatgcctggaagagcgggggcagctaccaccttatttactaacagtatttctaccggggtaattctggctggcgttattcagggagcaattgcacaaagttgggggcactttgctgtctactgggtaattgcggttatttctgttgtcgcattatttttaaccgcaaaggttaaagacgtttgatgacgtggacgatagcggaaagcccggtcatttgaccgggcaaggggattaattcataaacgcaggttgttttgcttcataagcggcaatggcgtcgtcgtgctgcaaggtaagcccaatactgtccagaccgttcatcatgcagtggcggcggaaggcatcgatggtaaagcgataggttttctctcccgctttcacctcttgcgcttccagatccacgtcgaaatggatccccggattagctttcaccagcgcaaacagttcgtccacttctgcatcgcttaatttcaccggcagcagctggttgttaaagctattgccgtagaagatgtcagcaaaactcggcgcaatcaccactttaaaaccgtagtcggtcaatgcccagggcgcgtgctcacgcgaagagccacagccgaagttttctcgtgccagcaaaatggaagcgccctgatactgcgggaagttcagcacgaagtccgggtttggctgttggcctttttcatccagaaaacgccagtcgttaaacagatgcgcgccaaaacccgtacgggtcactttctgcaaaaactgtttcgggatgattgcatcggtatcgacattggcggcatccagcggaaccaccaggcctgtgtgtttgataaatttctctgccatggtgtgctccttatttaatgttgcgaatgtcggcgaaatgtccggtcacagcagcagcggcagccattgccgggctgaccagatgcgtgcgcccgccgcgcccctggcggccttcaaagttacggttgctggtggaggcacaacgttcgcccggattcagacggtcgttgttcatcgccagacacattgagcagccaggcaagcgccattcaaaaccggcttcaataaagattttatccagaccttccgcttccgcctgggcttttaccgggccagagccgggaaccaccagtgcctgcacgcctggcgcgacttttcgccctttggcgatctccgctgccgcgcgtaaatcttcaatgcgcgagttggtacaggaaccgataaacactttgtcgatagccacttcggtcagcggaatacccggtttcagccccatataggccagcgctttttctgccgacgcgcgttcaaccggatcggcaaacgaagccggatcgggaatattgtcgttcacggaaatcacctggccgggattggtgccccaggtgacctgcggtgaaatttcttctgcttgcagagtgacaacggtatcgaaagttgcgccttcgtcggtttgcagggttttccagtaggcaacggcgtcgtcgaaatctttgcctttcggcgcatgcagacggcctttgacatagttaaaggtggtttcgtccggtgcaaccagaccggcttttgcgcccatttcgattgccatattgcacagggtcatacgaccttccatgcttaaatcacggattgcttcgccgcaaaactccaccacatgcccggtgccgcctgcgctaccggttttaccgataattgccagcacgatatcttttgcggtaatgcccggcgcggctttgccctggacttcaattttcatggtttttgcgcggccctgtttcagggtttgcgttgccagtacgtgttcaacttcggaagtgccgataccaaaggccagtgcgccaaacgcgccgtgggtggcggtatgcgagtcgccgcagacaatggtcatccccggcaaggtgacgccctgttccggccccattacgtggacgatcccctgatacgggtgattcaggtcatacagttcgacgccaaattctttgcagtttttgatcagttcctgcatctggatacgcgccatttcaccgcaggcattaatgtctttggtctgggtagagacgttgtgatccatggtagcgaaggttttgcccggctgacgtaccgggcgaccgtgggcgcgcagaccatcgaacgcctgcggtgaggtcacttcatgcaccaggtggcggtcgatatataacagtggggtttcgttttcggcttcgtacacaacgtgagcgtcgaacaatttttcgtataacgtcttagccatgattacaccccttctgctacatagcgggcaatgatatcgcccatttcatcggtactaacggcggcagcgccacgggctaaatccccggtgcgaatgccttcttctaatgcgcggttaatggcgcgttcaatggcgcaagccgcatcatcggcatccaggctgtaacgcagcagcagtgccagcgaaaggatttgtgcaatcgggttggcgatgtttttgcctgcgatatctggtgccgagccgcccgccggttcatacagtccaaaaccttgctcgttcaggctggcggaaggcaacatccccatcgagccagtgatcattgcgcactcgtcagacagaatgtcgccaaacaggttggagcacagcagaacgtcaaactgtgatggatctttaatcagctgcatggtggcgttgtcgatgtacatatgcgccagttcgacatccgggtattccgtggcgatctcgttaacgatctcccgccataaaatagaggattgcagcacgttggctttatcgatcgacgtcactttgtggcgacgcttgcgagcagattcaaacgcgatgcgggcgatacgttcgatctcaaaacggtgatacacctcggtatcaaaggctttttcatattgtccgctaccttcgcggccttttggctgaccgaaatagatgccgccggtcagttcgcgcacacacaggatgtcgaagccgtttgcggcaatgtctgcacgcagcggacagaatgcttccagcccctgatacagttttgccgggcgcaggttgctgaataatttgaagtgcttacgcagaggcagcagcgcgccgcgttctggttgctggtctggtggtaaatgttcccacttcgggccgcctaccgagccaaacagcacggcatcggcttgctcacaaccttcaaccgtcgcaggcggcagtggttgcccgtggttatcaatggctgcgccgcctacatcgtaatggctggtggtgatgcgcatcgcaaagcggttgcgcacggcatccagcactttcagcgcctgggtcatcacttccggaccaataccgtcccccggcaatacggcaatatggtaattcttcgacatcacacggtttccttgttgttttcgttgtgttgagctttgcgttgcaactctttttcgacttctgcggcacgccagatattgttcagaacgtgcaccatggctttggcagatgactcgacaatatcggtagccaggccgacgccgtggaagcggcgaccgttgtagttagcgacgatatccacctgacccagcgcatctttaccgtggcctttggcggtcaggctgtatttcaccagttcgacgttatattcagtgatgcggttaattgcctgatagacggcatcgaccggaccgttaccgttggcggcttctgctttgacttcttcgccacaggccagtttgacggcggcggtggcgatatcgttagagccagactgcacgctgaagtaatccagacggaaatgctccggctcttcttgctgcttaccgatgaaggccagcgcctccagatcgtaatcaaacacctgaccttttttgtccgccagcttcaggaaagcatcgtacaaattgtctaaattatattcactttctttataccccatctcatccatgcgatgtttcaccgccgcacgccccgaacgagaggtcagattcagctggatttggttcagaccaatagattctggtgtcatgatttcgtagttttcgcggtttttcagcacgccatcctggtgtataccggaggagtgtgcgaatgcgccgctgccaacaatggctttgtttgccgggatcggcatattacaaatctggctaactaactggctggtgcgccatatctcctggtgattaatggcggtgtggacgttgagaatatccttacgaactttgatcgccatgatgacttcttccagggaacagtttccggcacgctcgccgatcccgttcattgcgccttccacctggcgtgcaccggcatgtaccgccgccagtgagtttccgaccgccaggcccaaatcgtcgtgggtatgtacggagataatggctttgtcgatgttaggcacgcgttcatacaggccgctgatgattccggcgaactcaaacggcatggtgtagcccacggtgtccggaatgttgatggtggtggcaccggcattaatcgccgcttcgaccactcgcgccagatcggcaatgggtgtacgcccggcatcttcgcaagaaaattcaacatcatcggtgtaattacgggcgcgtttcaccatatagatagcgcgttcgatcacctcgtccagcgtgctgcgcagcttggtggcgatgtgcattggcgaagtggcaataaaggtatgaatacggaaggcttcggcgactttcagggattcggccgccacgtcgatatctttttccacgcagcgagctaacgcacatacgcggctgtttttaacctggcgggcgatggtttgcaccgattcaaaatcgcccggcgaagagacggggaaaccgacttccatcacgtcaacacccatacgctcaagggccagcgcaatttgcagtttttctttcacactcaagcttgcctgtaacgcctgttcaccgtcgcgcaatgtggtatcgaaaataatgacttgctggctcatggtttgggtccttgtctcttttagagcgcctcgcttcgggcataaaaaaacccgcgcaatggcgcgggttttttgtttgactgcgtgctggcttaatgctggatgccgctcactcgtctaccgcgcaaagaagatgcgtttagtagtagtagaccgataaagcgaacgatgtgagtcattaaatcagctccagatgaatgcgatatgcttttagagttactggatacaaaaacggatgtcaaccctgacgcaataaaaacgtcccgccagcgtgagttctgcatccgtaaaattagctaattgtgctgcggtggttaaagtaagcgatattaatttctgcttaactaccgacgcttttcatcggttgacatatttcagcataaatttttgcatctaatcaacgaggaaaaaggggacaaaatgcacgcgttgcaaaacctatcctgatgatttgtattgaattatatgttttgcgattttttttgatattgatttggtgaatattattgatcaattaatgttaagaattaatgcattaaatatataaattaattattaaataagcacatttaatccattttgtagatgattgagtattcgcggtagttatgattagattgttttcgcaacaaaaacattatggattattatgctgtggtaaatgactcattccacggcaatggattctgtttttatcagaacccgtatctttatgttttccgaattttactcattttgctttttcttattttatatgcatgataaatcatattcttcaggattatttctctgcattccaataagggaaagggagttaagtgtgacagtggagttaagtatgccagaggtacaaacagatcatccagagacggcggagttaagcaaaccacagctacgcatggtcgatctcaacttattaaccgttttcgatgccgtgatgcaggagcaaaacattactcgtgccgctcatgttctgggaatgtcgcaacctgcggtcagtaacgctgttgcacgcctgaaggtgatgtttaatgacgagctttttgttcgttatggccgtggtattcaaccgactgctcgcgcatttcaactttttggttcagttcgtcaggcattgcaactagtacaaaatgaattgcctggttcaggttttgaacccgcgagcagtgaacgtgtatttcatctttgtgtttgcagcccgttagacagcattctgacctcgcagatttataatcacattgagcagattgcgccaaatatacatgttatgttcaagtcttcattaaatcagaacactgaacatcagctgcgttatcaggaaacggagtttgtgattagttatgaagacttccatcgtcctgaatttaccagcgtaccattatttaaagatgaaatggtgctggtagccagcaaaaatcatccaacaattaagggcccgttactgaaacatgatgtttataacgaacaacatgcggcggtttcgctcgatcgtttcgcgtcatttagtcaaccttggtatgacacggtagataagcaagccagtatcgcgtatcagggcatggcaatgatgagcgtacttagcgtggtgtcgcaaacgcatttggtcgctattgcgccgcgttggctggctgaagagttcgctgaatccttagaattacaggtattaccgctgccgttaaaacaaaacagcagaacctgttatctctcctggcatgaagctgccgggcgcgataaaggccatcagtggatggaagagcaattagtctcaatttgcaaacgctaactgattgcagaataggtcagacatgaatgtctggtttattctgcattttttattgaatgtagaattttattctgaatgtgtgggctctctattttaggattaattaaaaaaatagagaaattgctgtaagttgtgggattcagccgatttattatcaatttaatcctctgtaatggaggattttatcgtttcttttcacctttcctcctgtttattcttattaccccgtgtttatgtctctggctgccaattgcttaagcaagatcggacggttaatgtgttttacacattttttccgtcaaacagtgaggcaggccatggagatgttgtctggagccgagatggtcgtccgatcgcttatcgatcagggcgttaaacaagtattcggttatcccggaggcgcagtccttgatatttatgatgcattgcataccgtgggtggtattgatcatgtattagttcgtcatgagcaggcggcggtgcatatggccgatggcctggcgcgcgcgaccggggaagtcggcgtcgtgctggtaacgtcgggtccaggggcgaccaatgcgattactggcatcgccaccgcttatatggattccattccattagttgtcctttccgggcaggtagcgacctcgttgataggttacgatgcctttcaggagtgcgacatggtggggatttcgcgaccggtggttaaacacagttttctggttaagcaaacggaagacattccgcaggtgctgaaaaaggctttctggctggcggcaagtggtcgcccaggaccagtagtcgttgatttaccgaaagatattcttaatccggcgaacaaattaccctatgtctggccggagtcggtcagtatgcgttcttacaatcccactactaccggacataaagggcaaattaagcgtgctctgcaaacgctggtagcggcaaaaaaaccggttgtctacgtaggcggtggggcaatcacggcgggctgccatcagcagttgaaagaaacggtggaggcgttgaatctgcccgttgtttgctcattgatggggctgggggcgtttccggcaacgcatcgtcaggcactgggcatgctgggaatgcacggtacctacgaagccaatatgacgatgcataacgcggatgtgattttcgccgtcggggtacgatttgatgaccgaacgacgaacaatctggcaaagtactgcccaaatgccactgttctgcatatcgatattgatcctacttccatttctaaaaccgtgactgcggatatcccgattgtgggggatgctcgccaggtcctcgaacaaatgcttgaactcttgtcgcaagaatccgcccatcaaccactggatgagatccgcgactggtggcagcaaattgaacagtggcgcgctcgtcagtgcctgaaatatgacactcacagtgaaaagattaaaccgcaggcggtgatcgagactctttggcggttgacgaagggagacgcttacgtgacgtccgatgtcgggcagcaccagatgtttgctgcactttattatccattcgacaaaccgcgtcgctggatcaattccggtggcctcggcacgatgggttttggtttacctgcggcactgggcgtcaaaatggcgttgccagaagaaaccgtggtttgcgtcactggcgacggcagtattcagatgaacatccaggaactgtctaccgcgttgcaatacgagttgcccgtactggtggtgaatctcaataaccgctatctggggatggtgaagcagtggcaggacatgatctattccggccgtcattcacaatcttatatgcaatcgctacccgatttcgtccgtctggcggaagcctatgggcatgtcgggatccagatttctcatccgcatgagctggaaagcaaacttagcgaggcgctggaacaggtgcgcaataatcgcctggtgtttgttgatgttaccgtcgatggcagcgagcacgtctacccgatgcagattcgcgggggcggaatggatgaaatgtggttaagcaaaacggagagaacctgattatgcgccggatattatcagtcttactcgaaaatgaatcaggcgcgttatcccgcgtgattggccttttttcccagcgtggctacaacattgaaagcctgaccgttgcgccaaccgacgatccgacattatcgcgtatgaccatccagaccgtgggcgatgaaaaagtacttgagcagatcgaaaagcaattacacaaactggtcgatgtcttgcgcgtgagtgagttggggcagggcgcgcatgttgagcgggaaatcatgctggtgaaaattcaggccagcggttacgggcgtgacgaagtgaaacgtaatacggaaatattccgtgggcaaattatcgatgtcacaccctcgctttataccgttcaattagcaggcaccagcggtaagcttgatgcatttttagcatcgattcgcgatgtggcgaaaattgtggaggttgctcgctctggtgtggtcggactttcgcgcggcgataaaataatgcgttgagaatgatctcaatgcgcaatttacagcccaacatgtcacgttgggctttttttgcgaaatcagtgggaacctggaataaaagcagttgccgcagttaattttctgcgcttagatgttaatgaatttaacccataccagtacaatggctatggtttttacattttacgcaaggggcaattgtgaaactggatgaaatcgctcggctggcgggagtgtcgcggaccactgcaagctatgttattaacggcaaagcgaagcaataccgtgtgagcgacaaaaccgttgaaaaagtcatggctgtggtgcgtgagcacaattaccacccgaacgccgtggcagctgggcttcgtgctggacgcacacgttctattggtcttgtgatccccgatctggagaacaccagctatacccgcatcgctaactatcttgaacgccaggcgcggcaacggggttatcaactgctgattgcctgctcagaagatcagccagacaacgaaatgcggtgcattgagcaccttttacagcgtcaggttgatgccattattgtttcgacgtcgttgcctcctgagcatcctttttatcaacgctgggctaacgacccgttcccgattgtcgcgctggaccgcgccctcgatcgtgaacacttcaccagcgtggttggtgccgatcaggatgatgccgaaatgctggcggaagagttacgtaagtttcccgccgagacggtgctttatcttggtgcgctaccggagctttctgtcagcttcctgcgtgaacaaggtttccgtactgcctggaaagatgatccgcgcgaagtgcatttcctgtatgccaacagctatgagcgggaggcggctgcccagttattcgaaaaatggctggaaacgcatccgatgccgcaggcgctgttcacaacgtcgtttgcgttgttgcaaggagtgatggatgtcacgctgcgtcgcgacggcaaactgccttctgacctggcaattgccacctttggcgataacgaactgctcgacttcttacagtgtccggtgctggcagtggctcaacgtcaccgcgatgtcgcagagcgtgtgctggagattgtcctggcaagcctggacgaaccgcgtaagccaaaacctggtttaacgcgcattaaacgtaatctctatcgccgcggcgtgctcagccgtagctaagccgcgaacaaaaatacgcgccaggtgaatttccctctggcgcgtagagtacgggactggacatcaatatgcttaaagtaaataagactattcctgactattattgataaatgcttttaaacccgcccgttaattaactcaccagctgaaattcacaataattaagtgatatcgacagcgcgtttttgcattattttgttacatgcggcgatgaattgccgatttaacaaacacttttctttgcttttgcgcaaacccgctggcatcaagcgccacacagacgtaacaaggactgttaaccggggaagatatgtcctaaaatgccgctcgcgtcgcaaactgacactttatatttgctgtggaaaatagtgagtcattttaaaacggtgatgacgatgagggattttttcttacagctattcataacgttaatttgcttcgcacgttggacgtaaaataaacaacgctgatattagccgtaaacatcgggttttttacctcggtatgccttgtgactggcttgacaagcttttcctcagctccgtaaactcctttcagtgggaaattgtggggcaaagtgggaataaggggtgaggctggcatgttccggggagcaacgttagtcaatctcgacagcaaagggcgcttatcagtgcctacccgttatcgggaacagctgcttgagaacgctgccggtcaaatggtttgcaccattgacatttatcacccgtgcctgctgctttaccccctgcctgaatgggaaattatcgagcaaaaattatcgcgtctgtcgagcatgaacccggttgagcgccgtgtgcagcgcctactgttaggtcatgccagcgaatgtcagatggatggcgcaggtcgattgttaatcgcgccagtactgcggcaacatgccgggctgacaaaagaagtgatgctggttggacagttcaacaagtttgagctgtgggatgaaacaacctggcatcaacaggtcaaggaagatatcgacgcagagcagttggctaccggagacttatcggagcgactgcaggacttgtctctataaaatgatggaaaactataaacatactacggtgctgctggatgaagccgttaatggcctcaatatccgtcctgatggcatctacattgatgggacttttggtcgcggtggtcactcacgtctgatcctctcgcagcttggcgaagaggggcgtttgctggcgatcgatcgcgacccgcaggctatcgccgttgcgaagactattgatgatccgcgcttctccatcatccacggacctttctccgcgctgggcgaatacgttgccgagcgcgatcttatcggcaagatcgacggcattctcctcgatcttggcgtctcttcaccgcaacttgatgatgctgaacgtggcttttcctttatgcgcgatggtccgctggacatgcgtatggacccaacccgtgggcagtcagccgctgaatggctacaaaccgcagaagaagccgatatcgcctgggtattgaaaacctatggtgaagagcgttttgccaaacgcattgcccgcgccattgtcgagcgtaaccgcgaacagccgatgacccgcaccaaagaactggcggaagtcgtggctgctgcaacgccggtgaaagataagtttaaacatcccgcgacccgtaccttccaggcggtgcgcatttgggtaaacagtgaactggaggagatagagcaggcgctaaaaagctcgctcaacgtgctggccccgggtgggcggctttcgatcatcagcttccactcgctggaagaccgtattgtgaaacgttttatgcgtgaaaacagccgcggtccgcaagttccggcagggttaccgatgactgaagagcagctcaaaaaactgggtggccgtcagctgcgagcactaggcaagttaatgccgggcgaagaagaggtggctgagaaccctcgtgcccgtagttcagttctgcgtattgcagagaggacgaatgcatgatcagcagagtgacagaagctctaagcaaagttaaaggatcgatgggaagccacgagcgccatgcattgcctggtgttatcggtgacgatcttttgcgatttgggaagctgccactctgcctgttcatttgcattattttgacggcggtgactgtggtaaccacggcgcaccatacccgtttactgaccgctcagcgcgaacaactggtgctggagcgagatgctttagacattgaatggcgcaacctgatccttgaagagaatgcgctcggcgaccatagccgggtggaaaggatcgccacggaaaagctgcaaatgcagcatgttgatccgtcacaagaaaatatcgtagtgcaaaaataaggataaacgcgacgcatgaaagcagcggcgaaaacgcagaaaccaaaacgtcaggaagaacatgccaactttatcagttggcgttttgcgttgttatgcggctgtattctcctggcgctggcttttctgctcggacgcgtagcgtggttacaagttatctccccggatatgctggtgaaagagggcgacatgcgttctcttcgcgttcagcaagtttccacctcccgcggcatgattactgaccgttctggtcgcccgttagcggtgagcgtgccggtaaaagcgatttgggctgacccgaaagaagtgcatgacgctggcggtatcagcgtcggtgaccgctggaaggcgctggctaacgcgctcaatattccgctggatcagctttcagcccgcattaacgccaacccgaaagggcgctttatttatctggcgcgtcaggtgaaccctgacatggcggactacatcaaaaaactgaaactgccggggattcatctgcgtgaagagtctcgccgttactatccgtccggcgaagtgactgctcacctcatcggctttactaacgtcgatagtcaagggattgagggcgttgagaagagtttcgataaatggcttaccgggcagccgggtgagcgcattgtgcgtaaagaccgctatggtcgcgtaattgaagatatttcttctactgacagccaggcagcgcacaacctggcgctgagtattgatgaacgcctgcaggcgctggtttatcgcgaactgaacaacgcggtggcctttaacaaggctgaatctggtagcgccgtgctggtggatgtcaacaccggtgaagtgctggcgatggctaacagcccgtcatacaaccctaacaatctgagcggcacgccgaaagaggcgatgcgtaaccgtaccatcaccgacgtgtttgaaccgggctcaacggttaaaccgatggtggtaatgaccgcgttgcaacgtggcgtggtgcgggaaaactcggtactcaataccattccttatcgaattaacggccacgaaatcaaagacgtggcacgctacagcgaattaaccctgaccggggtattacagaagtcgagtaacgtcggtgtttccaagctggcgttagcgatgccgtcctcagcgttagtagatacttactcacgttttggactgggaaaagcgaccaatttggggttggtcggagaacgcagtggcttatatcctcaaaaacaacggtggtctgacatagagagggccaccttctctttcggctacgggctaatggtaacaccattacagttagcgcgagtctacgcaactatcggcagctacggcatttatcgcccactgtcgattaccaaagttgaccccccggttcccggtgaacgtgtcttcccggaatccattgtccgcactgtggtgcatatgatggaaagcgtggcgctaccaggcggcggcggcgtgaaggcggcgattaaaggctatcgtatcgccattaaaaccggtaccgcgaaaaaggtcgggccggacggtcgctacatcaataaatatattgcttataccgcaggcgttgcgcctgcgagtcagccgcgcttcgcgctggttgttgttatcaacgatccgcaggcgggtaaatactacggcggcgccgtttccgcgccggtctttggtgccatcatgggcggcgtattgcgtaccatgaacatcgagccggatgcgctgacaacgggcgataaaaatgaatttgtgattaatcaaggcgaggggacaggtggcagatcgtaatttgcgcgaccttcttgctccgtgggtgccagacgcaccttcgcgagcactgcgagagatgacactcgacagccgtgtggctgcggcgggcgatctctttgtagctgtagtaggtcatcaggcggacgggcgtcgatatatcccgcaggcgatagcgcaaggtgtggctgccattattgcagaggcgaaagatgaggcgaccgatggtgaaatccgtgaaatgcacggcgtaccggtcatctatctcagccagctcaacgagcgtttatctgcactggcgggccgcttttaccatgaaccctctgacaatttacgtctcgtgggcgtaacgggcaccaacggcaaaaccacgactacccagctgttggcgcagtggagccaactgcttggcgaaatcagcgcggtaatgggcaccgttggtaacggcctgctggggaaagtgatcccgacagaaaatacaaccggttcggcagtcgatgttcagcatgagctggcggggctggtggatcagggcgcgacgttttgcgcaatggaagtttcctcccacgggctggtacagcaccgtgtggcggcattgaaatttgcggcgtcggtctttaccaacttaagccgcgatcaccttgattatcatggtgatatggaacactacgaagccgcgaaatggctgctttattctgagcatcattgcggtcaggcgattattaacgccgacgatgaagtgggccgccgctggctggcaaaactgccggacgcggttgcggtatcaatggaagatcatattaatccgaactgtcacggacgctggttgaaagcgaccgaagtgaactatcacgacagcggtgcgacgattcgctttagctcaagttggggcgatggcgaaattgaaagccatctgatgggcgcttttaacgtcagcaacctgctgctcgcgctggcgacactgttggcactcggctatccactggctgatctgctgaaaaccgccgcgcgtctgcaaccggtttgcggacgtatggaagtgttcactgcgccaggcaaaccgacggtggtggtggattacgcgcatacgccggatgcactggaaaaagccttacaggcggcgcgtctgcactgtgcgggcaagctgtggtgtgtctttggctgtggtggcgatcgcgataaaggtaagcgtccactgatgggcgcaattgccgaagagtttgctgacgtggcggtggtgacggacgataacccgcgtaccgaagaaccgcgtgccatcatcaacgatattctggcgggaatgttagatgccggacatgccaaagtgatggaaggccgtgctgaagcggtgacttgcgccgttatgcaggctaaagagaatgatgtggtactggtcgcgggcaaaggccatgaagattaccagattgttggcaatcagcgtctggactactccgatcgcgtcacggtggcgcgtctgctgggggtgattgcatgattagcgtaacccttagccaacttaccgacattctcaacggtgaactgcaaggtgcagatatcacccttgatgctgtaaccactgatacccgaaaactgacgccgggctgcctgtttgttgccctgaaaggcgaacgttttgatgcccacgattttgccgaccaggcgaaagctggcggcgcaggcgcactactggttagccgtccgctggacatcgacctgccgcagttaatcgtcaaggatacgcgtctggcgtttggtgaactggctgcatgggttcgccagcaagttccggcgcgcgtggttgctctgacggggtcctccggcaaaacctccgttaaagagatgacggcggcgattttaagccagtgcggcaacacgctttatacggcaggcaatctcaacaacgacatcggtgtaccgatgacgctgttgcgcttaacgccggaatacgattacgcagttattgaacttggcgcgaaccatcagggcgaaatagcctggactgtgagtctgactcgcccggaagctgcgctggtcaacaacctggcagcggcgcatctggaaggttttggctcgcttgcgggtgtcgcgaaagcgaaaggtgaaatctttagcggcctgccggaaaacggtatcgccattatgaacgccgacaacaacgactggctgaactggcagagcgtaattggctcacgcaaagtgtggcgtttctcacccaatgccgccaacagcgatttcaccgccaccaatatccatgtgacctcgcacggtacggaatttaccctacaaaccccaaccggtagcgtcgatgttctgctgccgttgccggggcgtcacaatattgcgaatgcgctggcagccgctgcgctctccatgtccgtgggcgcaacgcttgatgctatcaaagcggggctggcaaatctgaaagctgttccaggccgtctgttccccatccaactggcagaaaaccagttgctgctcgacgactcctacaacgccaatgtcggttcaatgactgcagcagtccaggtactggctgaaatgccgggctaccgcgtgctggtggtgggcgatatggcggaactgggcgctgaaagcgaagcctgccatgtacaggtgggcgaggcggcaaaagctgctggtattgaccgcgtgttaagcgtgggtaaacaaagccatgctatcagcaccgccagcggcgttggcgaacattttgctgataaaactgcgttaattacgcgtcttaaattactgattgctgagcaacaggtaattacgattttagttaagggttcacgtagtgccgccatggaagaggtagtacgcgctttacaggagaatgggacatgttagtttggctggccgaacatttggtcaaatattattccggctttaacgtcttttcctatctgacgtttcgcgccatcgtcagcctgctgaccgcgctgttcatctcattgtggatgggcccgcgtatgattgctcatttgcaaaaactttcctttggtcaggtggtgcgtaacgacggtcctgaatcacacttcagcaagcgcggtacgccgaccatgggcgggattatgatcctgacggcgattgtgatctccgtactgctgtgggcttacccgtccaatccgtacgtctggtgcgtgttggtggtgctggtaggttacggtgttattggctttgttgatgattatcgcaaagtggtgcgtaaagacaccaaagggttgatcgctcgttggaagtatttctggatgtcggtcattgcgctgggtgtcgccttcgccctgtaccttgccggcaaagacacgcccgcaacgcagctggtggtcccattctttaaagatgtgatgccgcagctggggctgttctacattctgctggcttacttcgtcattgtgggtactggcaacgcggtaaacctgaccgatggtctcgacggcctggcaattatgccgaccgtatttgtcgccggtggttttgcgctggtggcgtgggcgaccggcaatatgaactttgccagctacttgcatataccgtatctgcgacacgccggggaactggttattgtctgtaccgcgatagtcggggcaggactgggcttcctgtggtttaacacctatccggcgcaggtctttatgggcgatgtaggttcgctggcgttaggtggtgcgttaggcattatcgccgtactgctacgtcaggaattcctgctggtgattatggggggcgtgttcgtggtagaaacgctttctgtcatcctgcaggtcggctcctttaaactgcgcggacaacgtattttccgcatggcaccgattcatcaccactatgaactgaaaggctggccggaaccgcgcgtcattgtgcgtttctggattatttcgctgatgctggttctgattggtctggcaacgctgaaggtacgttaatcatggctgattatcagggtaaaaatgtcgtcattatcggcctgggcctcaccgggctttcctgcgtggactttttcctcgctcgcggtgtgacgccgcgcgttatggatacgcgtatgacaccgcctggcctggataaattacccgaagccgtagaacgccacacgggcagtctgaatgatgaatggctgatggcggcagatctgattgtcgccagtcccggtattgcactggcgcatccatccttaagcgctgccgctgatgccggaatcgaaatcgttggcgatatcgagctgttctgtcgcgaagcacaagcaccgattgtggcgattaccggttctaacggcaaaagcacggtcaccacgctagtgggtgaaatggcgaaagcggcgggggttaacgttggtgtgggtggcaatattggcctgcctgcgttgatgctactggatgatgagtgtgaactgtacgtgctggaactgtcgagcttccagctggaaaccacctccagcttacaggcggtagcagcgaccattctgaacgtgactgaagatcatatggatcgctatccgtttggtttacaacagtatcgtgcagcaaaactgcgcatttacgaaaacgcgaaagtttgcgtggttaatgctgatgatgccttaacaatgccgattcgcggtgcggatgaacgctgcgtcagctttggcgtcaacatgggtgactatcacctgaatcatcagcagggcgaaacctggctgcgggttaaaggcgagaaagtgctgaatgtgaaagagatgaaactttccgggcagcataactacaccaatgcgctggcggcgctggcgctggcagatgctgcagggttaccgcgtgccagcagcctgaaagcgttaaccacattcactggtctgccgcatcgctttgaagttgtgctggagcataacggcgtacgttggattaacgattcgaaagcgaccaacgtcggcagtacggaagcggcgctgaatggcctgcacgtagacggcacactgcatttgttgctgggtggcgatggtaaatcggcggactttagcccactggcgcgttacctgaatggcgataacgtacgtctgtattgtttcggtcgtgacggcgcgcagctggcggcgctacgcccggaagtggcagaacaaaccgaaactatggaacaggcgatgcgcttgctggctccgcgtgttcagccgggcgatatggttctgctctccccagcctgtgccagccttgatcagttcaagaactttgaacaacgaggcaatgagtttgcccgtctggcgaaggagttaggttgatgcgtttatctctccctcgcctgaaaatgccgcgcctgccaggattcagtatcctggtctggatctccacggcgctaaagggctgggtgatgggctcgcgggaaaaagataccgacagcctgatcatgtacgatcgcaccttactgtggctgaccttcggcctcgcggcgattggctttatcatggtgacctcggcgtcaatgcccatagggcaacgcttaaccaacgatccgttcttcttcgcgaagcgtgatggtgtctatctgattttggcgtttattctggcgatcattacgctgcgtctgccgatggagttctggcaacgctacagtgccacgatgctgctcggatctatcatcctgctgatgatcgtcctggtagtgggtagctcggttaaaggggcatcgcgttggatcgatctcggtttgctgcgtatccagcctgcggagctgacaaaactgtcgctgttttgctatatcgccaactatctggtgcgtaaaggcgacgaagtacgtaataacctgcgcggcttcctgaaaccgatgggcgtgattctggtgttggcagtgttactgctggcacagccagaccttggtacggtggtggtgttgtttgtgactacgctggcgatgttgttcctggcgggagcgaaattgtggcagttcattgccattatcggtatgggcatttcagcggttgtgttgctgatactcgccgaaccgtaccgtatccgccgtgttaccgcattctggaacccgtgggaagatccctttggcagcggctatcagttaacgcaatcgctgatggcgtttggtcgcggcgaactttgggggcaaggtttaggtaactcggtacaaaaactggagtatctgccggaagcgcacactgactttattttcgccattatcggcgaagaactggggtatgtcggtgtggtgctggcacttttaatggtattcttcgtcgcttttcgcgcgatgtcgattggccgtaaagcattagaaattgaccaccgtttttccggttttctcgcctgttctattggcatctggtttagcttccaggcgctggttaacgtaggcgcggcggcggggatgttaccgaccaaaggtctgacattgccgctgatcagttacggtggttcgagcttactgattatgtcgacagccatcatgatgctgttgcgtattgattatgaaacgcgtctggagaaagcgcaggcgtttgtacgaggttcacgatgagtggtcaaggaaagcgattaatggtgatggcaggcggaaccggtggacatgtattcccgggactggcggttgcgcaccatctaatggctcagggttggcaagttcgctggctggggactgccgaccgtatggaagcggacttagtgccaaaacatggcatcgaaattgatttcattcgtatctctggtctgcgtggaaaaggtataaaagcactgatagctgccccgctgcgtatcttcaacgcctggcgtcaggcgcgggcgattatgaaagcgtacaaacctgacgtggtgctcggtatgggaggctacgtgtcaggtccaggtggtctggccgcgtggtcgttaggcattccggttgtacttcatgaacaaaacggtattgcgggcttaaccaataaatggctggcgaagattgccaccaaagtgatgcaggcgtttccaggtgctttccctaatgcggaagtagtgggtaacccggtgcgtaccgatgtgttggcgctgccgttgccgcagcaacgtttggctggacgtgaaggtccggttcgtgtgctggtagtgggtggttctcagggcgcacgcattcttaaccagacaatgccgcaggttgctgcgaaactgggtgattcagtcactatctggcatcagagcggcaaaggttcgcaacaatccgttgaacaggcgtatgccgaagcggggcaaccgcagcataaagtgacggaatttattgatgatatggcggcggcgtatgcgtgggcggatgtcgtcgtttgccgctccggtgcgttaacggtgagtgaaatcgccgcggcaggactaccggcgttgtttgtgccgtttcaacataaagaccgccagcaatactggaatgcgctaccgctggaaaaagcgggcgcagccaaaattatcgagcagccacagcttagcgtggatgctgtcgccaacaccctggccgggtggtcgcgagaaaccttattaaccatggcagaacgcgcccgcgctgcatccattccggatgccaccgagcgagtggcaaatgaagtgagccgggttgcccgggcgtaattgtagcgatgccttttgcatcgtatgaatttaagaagttaatggcgtaaagaatgaatacacaacaattggcaaaactgcgttccatcgtgcccgaaatgcgtcgcgttcggcacatacattttgtcggcattggtggtgccggtatgggcggtattgccgaagttctggccaatgaaggttatcagatcagtggttccgatttagcgccaaatccggtcacgcagcagttaatgaatctgggtgcgacgatttatttcaaccatcgcccggaaaacgtacgtgatgccagcgtggtcgttgtttccagcgcgatttctgccgataacccggaaattgtcgccgctcatgaagcgcgtattccggtgatccgtcgtgccgaaatgctggctgagttaatgcgttttcgtcatggcatcgccattgccggaacgcacggcaaaacgacaaccaccgcgatggtttccagcatctacgcagaagcggggctcgacccaaccttcgttaacggcgggctggtaaaagcggcgggggttcatgcgcgtttggggcatggtcggtacctgattgccgaagcagatgagagtgatgcatcgttcctgcatctgcaaccgatggtggcgattgtcaccaatatcgaagccgaccacatggatacctaccagggcgactttgagaatttaaaacagacttttattaattttctgcacaacctgccgttttacggtcgtgcggtgatgtgtgttgatgatccggtgatccgcgaattgttaccgcgagtggggcgtcagaccacgacttacggcttcagcgaagatgccgacgtgcgtgtagaagattatcagcagattggcccgcaggggcactttacgctgctgcgccaggacaaagagccgatgcgcgtcaccctgaatgcgccaggtcgtcataacgcgctgaacgccgcagctgcggttgcggttgctacggaagagggcattgacgacgaggctattttgcgggcgcttgaaagcttccaggggactggtcgccgttttgatttcctcggtgaattcccgctggagccagtgaatggtaaaagcggtacggcaatgctggtcgatgactacggccaccacccgacggaagtggacgccaccattaaagcggcgcgcgcaggctggccggataaaaacctggtaatgctgtttcagccgcaccgttttacccgtacgcgcgacctgtatgatgatttcgccaatgtgctgacgcaggttgataccctgttgatgctggaagtgtatccggctggcgaagcgccaattccgggagcggacagccgttcgctgtgtcgcacaattcgtggacgtgggaaaattgatcccattctggtgccggatccggcgcgggtagccgagatgctggcaccggtattaaccggtaacgacctgattctcgttcagggggctggtaatattggaaaaattgcccgttctttagctgaaatcaaactgaagccgcaaactccggaggaagaacaacatgactgataaaatcgcggtcctgttgggtgggacctccgctgagcgggaagtttctctgaattctggcgcagcggtgttagccggactgcgtgaaggcggtattgacgcgtatcctgtcgacccgaaagaagtcgacgtgacgcaactgaagtcgatgggctttcagaaagtgtttatcgcgctacacggtcgcggcggtgaagatggtacgctgcaggggatgctcgagctgatgggcttgccttataccggaagcggagtgatggcatctgcgctttcaatggataaactacgcagcaaacttctatggcaaggtgccggtttaccggtcgcgccgtgggtagcgttaacccgcgcagagtttgaaaaaggcctgagcgataagcagttagcagaaatttctgctctgggtttgccggttatcgttaagccgagccgcgaaggttccagtgtgggaatgtcaaaagtagtagcagaaaatgctctacaagatgcattaagattggcatttcagcacgatgaagaagtattgattgaaaaatggctaagtgggccggagttcacggttgcgatactcggtgaagaaattttaccgtcaatacgtattcaaccgtccggaaccttctatgattatgaggcgaagtatctctctgatgagacacagtatttctgccccgcaggtctggaagcgtcacaagaggccaatttgcaggcattagtgctgaaagcatggacgacgttaggttgcaaaggatggggacgtattgacgttatgctggacagcgatggacagttttatctgctggaagccaatacctcaccgggtatgaccagccacagcctggtgccgatggcggcacgtcaggcaggtatgagcttctcgcagttggtagtacgaattctggaactggcggactaatatgtcgcaggctgctctgaacacgcgaaacagcgaagaagaggtttcttctcgccgcaataatggaacgcgtctggcggggatccttttcctgctgaccgttttaacgacagtgttggtgagcggctgggtcgtgttgggctggatggaagatgcgcaacgcctgccgctctcaaagctggtgttgaccggtgaacgccattacacacgtaatgacgatatccggcagtcgatcctggcattgggtgagccgggtacctttatgacccaggatgtcaacatcatccagacgcaaatagaacaacgcctgccgtggattaagcaggtgagcgtcagaaagcagtggcctgatgaattgaagattcatctggttgaatatgtgccgattgcgcggtggaatgatcaacatatggtagacgcggaaggaaataccttcagcgtgccgccagaacgcaccagcaagcaggtgcttccaatgctgtatggcccggaaggcagcgccaatgaagtgttgcagggctatcgcgaaatggggcagatgctggcaaaggacagatttactctgaaggaagcggcgatgaccgcgcggcgttcctggcagttgacgctgaataacgatattaagctcaatcttggccggggcgatacgatgaaacgtttggctcgctttgtagaactttatccggttttacagcagcaggcgcaaaccgatggcaaacggattagctacgttgatttgcgttatgactctggagcggcagtaggctgggcgcccttgccgccagaggaatctactcagcaacaaaatcaggcacaggcagaacaacaatgatcaaggcgacggacagaaaactggtagtaggactggagattggtaccgcgaaggttgccgctttagtaggggaagttctgcccgacggtatggtcaatatcattggcgtgggcagctgcccgtcgcgtggtatggataaaggcggggtgaacgacctcgaatccgtggtcaagtgcgtacaacgcgccattgaccaggcagaattgatggcagattgtcagatctcttcggtatatctggcgctttctggtaagcacatcagctgccagaatgaaattggtatggtgcctatttctgaagaagaagtgacgcaagaagatgtggaaaacgtcgtccataccgcgaaatcggtgcgtgtgcgcgatgagcatcgtgtgctgcatgtgatcccgcaagagtatgcgattgactatcaggaagggatcaagaatccggtaggactttcgggcgtgcggatgcaggcaaaagtgcacctgatcacatgtcacaacgatatggcgaaaaacatcgtcaaagcggttgaacgttgtgggctgaaagttgaccaactgatatttgccggactggcatcaagttattcggtattgacggaagatgaacgtgaactgggtgtctgcgtcgtcgatatcggtggtggtacaatggatatcgccgtttataccggtggggcattgcgccacactaaggtaattccttatgctggcaatgtcgtgaccagtgatatcgcttacgcctttggcacgccgccaagcgacgccgaagcgattaaagttcgccacggttgtgcgctgggttccatcgttggaaaagatgagagcgtggaagtgccgagcgtaggtggtcgtccgccacggagtctgcaacgtcagacactggcagaggtgatcgagccgcgctataccgagctgctcaacctggtcaacgaagagatattgcagttgcaggaaaagcttcgccaacaaggggttaaacatcacctggcggcaggcattgtattaaccggtggcgcagcgcagatcgaaggtcttgcagcctgtgctcagcgcgtgtttcatacgcaagtgcgtatcggcgcgccgctgaacattaccggtttaacggattatgctcaggagccgtattattcgacggcggtgggattgcttcactatgggaaagagtcacatcttaacggtgaagctgaagtagaaaaacgtgttacagcatcagttggctcgtggatcaagcgactcaatagttggctgcgaaaagagttttaatttttatgaggccgacgatgattacggcctcaggcgacaggcacaaatcggagagaaactatgtttgaaccaatggaacttaccaatgacgcggtgattaaagtcatcggcgtcggcggcggcggcggtaatgctgttgaacacatggtgcgcgagcgcattgaaggtgttgaattcttcgcggtaaataccgatgcacaagcgctgcgtaaaacagcggttggacagacgattcaaatcggtagcggtatcaccaaaggactgggcgctggcgctaatccagaagttggccgcaatgcggctgatgaggatcgcgatgcattgcgtgcggcgctggaaggtgcagacatggtctttattgctgcgggtatgggtggtggtaccggtacaggtgcagcaccagtcgtcgctgaagtggcaaaagatttgggtatcctgaccgttgctgtcgtcactaagcctttcaactttgaaggcaagaagcgtatggcattcgcggagcaggggatcactgaactgtccaagcatgtggactctctgatcactatcccgaacgacaaactgctgaaagttctgggccgcggtatctccctgctggatgcgtttggcgcagcgaacgatgtactgaaaggcgctgtgcaaggtatcgctgaactgattactcgtccgggtttgatgaacgtggactttgcagacgtacgcaccgtaatgtctgagatgggctacgcaatgatgggttctggcgtggcgagcggtgaagaccgtgcggaagaagctgctgaaatggctatctcttctccgctgctggaagatatcgacctgtctggcgcgcgcggcgtgctggttaacatcacggcgggcttcgacctgcgtctggatgagttcgaaacggtaggtaacaccatccgtgcatttgcttccgacaacgcgactgtggttatcggtacttctcttgacccggatatgaatgacgagctgcgcgtaaccgttgttgcgacaggtatcggcatggacaaacgtcctgaaatcactctggtgaccaataagcaggttcagcagccagtgatggatcgctaccagcagcatgggatggctccgctgacccaggagcagaagccggttgctaaagtcgtgaatgacaatgcgccgcaaactgcgaaagagccggattatctggatatcccagcattcctgcgtaagcaagctgattaagaattgactggaatttgggtttcgaggctctttgtgctaaactggcccgccgaatgtatagtacacttcggttggataggtaatttggcgagataatacgatgatcaaacaaaggacacttaaacgtatcgttcaggcgacgggtgtcggtttacataccggcaagaaagtcaccctgacgttacgccctgcgccggccaacaccggggtcatctatcgtcgcaccgacttgaatccaccggtagatttcccggccgatgccaaatctgtgcgtgataccatgctctgtacgtgtctggtcaacgagcatgatgtacggatttcaaccgtagagcacctcaatgctgctctcgcgggcttgggcatcgataacattgttatcgaagttaacgcgccggaaatcccgatcatggacggcagcgccgctccgtttgtatacctgctgcttgacgccggtatcgacgagttgaactgcgccaaaaaatttgttcgcatcaaagagactgttcgtgtcgaagatggcgataagtgggctgaatttaagccgtacaatggtttttcgctggatttcaccatcgattttaaccatccggctattgattccagcaaccagcgctatgcgatgaacttctccgctgatgcgtttatgcgccagatcagccgtgcgcgtacgttcggtttcatgcgtgatatcgaatatctgcagtcccgtggtttgtgcctgggcggcagcttcgattgtgccatcgttgttgacgattatcgcgtactgaacgaagacggcctgcgttttgaagacgaatttgtgcgtcacaaaatgctcgatgcgatcggtgacttgttcatgtgtggtcacaatattattggtgcatttaccgcttataaatccggtcatgcactgaataacaaactgctgcaggctgtcctggcgaaacaggaagcctgggaatatgtgaccttccaggacgacgcagaactgccgttggccttcaaagcgccttcagctgtactggcataacgacatttatactgtcgtataaaattcgactggcaaatctggcactctctccggccaggtgaaccagtcgtttttttttgaattttataagagctataaaaaacggtgcgaacgctgttttcttaagcacttttccgcacaacttatcttcattcgtgctgtggactgcaggctttaatgataagatttgtgcgctaaatacgtttgaatatgatcgggatggcaataacgtgagtggaatactgacgcgctggcgacagtttggtaaacgctacttctggccgcatctcttattagggatggttgcggcgagtttaggtttgcctgcgctcagcaacgccgccgaaccaaacgcgcccgcaaaagcgacaacccgcaaccacgagccttcagccaaagttaactttggtcaattggccttgctggaagcgaacacacgccgcccgaattcgaactattccgttgattactggcatcaacatgccattcgcacggtaatccgtcatctttctttcgcaatggcaccgcaaacactgcccgttgctgaagaatctttgcctcttcaggcgcaacatcttgcattactggatacgctcagcgcgctgctgacccaggaaggcacgccgtctgaaaagggttatcgcattgattatgcgcattttaccccacaagcaaaattcagcacgcccgtctggataagccaggcgcaaggcatccgtgctggccctcaacgcctcacctaacaacaataaacctttacttcattttattaactccgcaacgcggggcgtttgagattttattatgctaatcaaattgttaactaaagttttcggtagtcgtaacgatcgcaccctgcgccggatgcgcaaagtggtcaacatcatcaatgccatggaaccggagatggaaaaactctccgacgaagaactgaaagggaaaaccgcagagtttcgtgcacgtctggaaaaaggcgaagtgctggaaaatctgatcccggaagctttcgccgtggtacgtgaggcaagtaagcgcgtctttggtatgcgtcacttcgacgttcagttactcggcggtatggttcttaacgaacgctgcatcgccgaaatgcgtaccggtgaaggaaaaaccctgaccgcaacgctgcctgcttacctgaacgcactaaccggtaaaggcgtgcacgtagttaccgtcaacgactacctggcgcaacgtgacgccgaaaacaaccgtccgctgtttgaattccttggcctgactgtcggtatcaacctgccgggcatgccagcaccggcaaagcgcgaagcttacgcagctgacatcacttacggtacgaacaacgaatacggctttgactacctgcgcgacaacatggcgttcagccctgaagaacgtgtacagcgtaaactgcactatgcgctggtggacgaagtggactccatcctgatcgatgaagcgcgtacaccgctgatcatttccggcccggcagaagacagctcggaaatgtataaacgcgtgaataaaattattccgcacctgatccgtcaggaaaaagaagactccgaaaccttccagggcgaaggccacttctcggtggacgaaaaatctcgccaggtgaacctgaccgaacgtggtctggtgctgattgaagaactgctggtgaaagagggcatcatggatgaaggggagtctctgtactctccggccaacatcatgctgatgcaccacgtaacggcggcgctgcgcgctcatgcgctgtttacccgtgacgtcgactacatcgttaaagatggtgaagttatcatcgttgacgaacacaccggtcgtaccatgcagggccgtcgctggtccgatggtctgcaccaggctgtggaagcgaaagaaggtgtgcagatccagaacgaaaaccaaacgctggcttcgatcaccttccagaactacttccgtctgtatgaaaaactggcggggatgaccggtactgctgataccgaagctttcgaatttagctcaatctacaagctggataccgtcgttgttccgaccaaccgtccaatgattcgtaaagatctgccggacctggtctacatgactgaagcggaaaaaattcaggcgatcattgaagatatcaaagaacgtactgcgaaaggccagccggtgctggtgggtactatctccatcgaaaaatcggagctggtgtcaaacgaactgaccaaagccggtattaagcacaacgtcctgaacgccaaattccacgccaacgaagcggcgattgttgctcaggcaggttatccggctgcggtgactatcgcgaccaatatggcgggtcgtggtacagatattgtgctcggtggtagctggcaggcagaagttgccgcgctggaaaatccgaccgcagagcaaattgaaaaaattaaagccgactggcaggtacgtcacgatgcggtactggaagcaggtggcctgcatatcatcggtaccgagcgtcacgaatcccgtcgtatcgataaccagttgcgcggtcgttctggtcgtcagggggatgctggttcttcccgtttctacctgtcgatggaagatgcgctgatgcgtatttttgcttccgaccgagtatccggcatgatgcgtaaactgggtatgaagccaggcgaagccattgaacacccgtgggtgactaaagcgattgccaacgcccagcgtaaagttgaaagccgtaacttcgacattcgtaagcaactgctggaatatgatgacgtggctaacgatcagcgtcgcgccatttactcccagcgtaacgaactgttggatgtcagcgatgtgagcgaaaccattaacagcattcgtgaagatgtgttcaaagcgaccattgatgcctacattccaccacagtcgctggaagaaatgtgggatattccggggctgcaggaacgtctgaagaacgatttcgacctcgatttgccaattgccgagtggctggataaagaaccagaactgcatgaagagacgctgcgtgagcgcattctggcgcagtccatcgaagtgtatcagcgtaaagaagaagtggttggtgctgagatgatgcgtcacttcgagaaaggcgtcatgctgcaaacgcttgactccctgtggaaagagcacctggcagcgatggactatctgcgtcagggtatccacctgcgtggctacgcacagaaagatccgaagcaggaatacaaacgtgaatcgttctccatgtttgcagcgatgctggagtcgttgaaatatgaagttatcagtacgctgagcaaagttcaggtacgtatgcctgaagaggttgaggagctggaacaacagcgtcgtatggaagccgagcgtttagcgcaaatgcagcagcttagccatcaggatgacgactctgcagccgcagctgcactggcggcgcaaaccggagagcgcaaagtaggacgtaacgatccttgcccgtgcggttctggtaaaaaatacaagcagtgccatggccgcctgcaataaaagctaactgttgaagtaaaaggcgcaggattctgcgccttttttataggtttaagacaatgaaaaagctgcaaattgcggtaggtattattcgcaacgagaacaatgaaatctttataacgcgtcgcgcagcagatgcgcacatggcgaataaactggagtttcccggcggtaaaattgaaatgggtgaaacgccggaacaggcggtggtgcgtgaacttcaggaagaagtcgggattaccccccaacatttttcgctatttgaaaaactggaatatgaattcccggacaggcatataacactgtggttttggctggtcgaacgctgggaaggggagccgtggggtaaagaagggcaacccggtgagtggatgtcgctggtcggtcttaatgccgatgattttccgccagccaatgaaccggtaattgcgaagcttaaacgtctgtaggtcagataaggcgttttcgccgcatccgacattcgcacacgatgcctgatgcgacgctggcgcgtcttatcaggcctaaagggatttctaactcattgataaatttgtttttgtaggtcggataaggcgttcacgccgcatccgacatttgcacaagatgcctgatgcgacgctgtccgcgtcttatcaggcctacgtgcggcatcagacaaatgtcactgctttggttcttcgctccagtcatcgctttcggaaagatcgccactgctggggattcgtttttcttcagcagcccattctccgaggtcgatcagctgacaacgtttggagcaaaatggccgaaacgggctgatttcaccccacaccaccgttttcccgcaggttgggcaattcaccgtaatagtttctgacatttttactccttagcaacaggccagttcgaaatccagacgttccggtacctgtccgttttcagtgtccagcggcataaaacgaatggcaaaacggctcttatgtccggaaatttgcggataaagctgtgaatcgagcgacagattcaggcgcagcaagtcggcatcgccaccgttatcctgataaaaaccattcaggctggtttgtttacggaagggggccgactggcgaattaaatccagcaccatggtaagtgcctgggtgagcgggttcaggctggcaatccaggtttctacctggctgtcgcgctgcgcctggggtagatgcagccaaatgtgcaatgtaggtaaatcaaagctgcaacagccgcctgggatgctcagtcgctgacgcaccagagcaatcaaacgatcttcacgcagaaattgcccgatacgcggcgcggaaattaatacgctccccgccgcttttaactgctgaattaatgcttcaatacggctctggtccacgccaggcacgccaatccaggtctggagtttacgttgctgccggtcaagttctttcaacagctcagtgcggacttcgccgcgctcgaaaacatccagtaattcactgacattacggaagaaatgcagcgcgccagcgtggtcaacgatgggtaaattaacggtgagttgctgaatcaaaaactcaatgcgcagccatgtacgcattttttcatttagtggatgttcaaaaaggacctgggtctgcattacggtttttcctgtgagacaaactgcgacgcaagctgcaaatagtgtgcgtgcaggcgggcaacatccgatgcgatagcatccggtgcgccgttattatcaatgacgtcatctgccacggcaaggcgggcttcgcgcgttgcctgagcagcaaggatttgttcgacatgctcgcgagttacatcatcgcgctgcatggtgcgcttaagttgcgtttctgggctgacatccaccacaagcactcgattcgcttttttatacagtgagttttctaccagcaatggcacaacccacagtacatagggggaagtagcttgctggatctggtgttgcgtctcttgctgaatcagcggatgcagcagggcgttaagccagtttttctcttccgggttggcgaagatccgctcgcgcaaggcccggcgctgcaatgttccatcagcagcaatcatgttagcgccaaagtgatcagcaatggcatgtagcgcaggtgcacctggttcaaccacctgacgcgcaataatatcggcatcaatgacgttaattccgagatcagcaaacgcattggcaacggtactcttgccactgccaatgcctcccgttaaggcaactatatacctcataatttatattcccgggaattcatcatgattatcaaaacgttaaaaatgagtgcacgaaagcgaaattgatgaaacgttcgctcactatttaccaggtaaatttatgggattgtagcgtaaaaaaagacaatttcgcagtcttgcgccgcattgattagtgcgtatgatagcgtcactggagttgcgctcttacccttatagccattaaccccaggaatccgcacatgcgtattgaagaagatctgaagttaggttttaaagacgttctcatccgccctaaacgctccactcttaaaagccgttccgatgttgaactggaacgtcaattcaccttcaaacattcaggtcagagctggtccggcgtgccgattatcgccgcaaatatggacaccgtaggcacattttctatggcctctgcgctggcttcttttgatattttgactgctgtgcataaacactattctgtcgaagagtggcaagcgtttatcaacaattcttccgctgatgtgctgaaacatgtgatggtttctaccggtacgtctgatgcggatttcgaaaaaactaaacagattctcgacctgaacccggcattaaacttcgtttgtattgacgtggcgaatggttattccgaacacttcgtgcagttcgttgcgaaagcgcgtgaagcgtggccgaccaaaaccatttgtgctggtaacgtagtgactggtgaaatgtgtgaggagcttatcctctcaggtgccgatatcgttaaagttggcattggcccaggttctgtttgtacaactcgcgtcaaaacaggcgtcggttatccgcaactttctgcggtaatcgaatgtgccgatgctgcgcacggtctgggcggaatgatcgtcagcgatggtggctgcaccacgccgggcgatgtggcgaaagcctttggcggcggtgccgatttcgtcatgcttggcggcatgctggcgggccacgaagagagcggcggtcgcatcgttgaggagaacggcgagaaatttatgctgttctacggcatgagctccgagtctgcgatgaaacgtcacgttggcggcgttgcggaatatcgcgcagcagaaggtaaaaccgttaagctgccgctgcgaggcccggttgaaaataccgcgcgagatattttgggcggcctgcgttcagcttgtacatacgttggggcttcacgcctgaaagagctgaccaagcgcaccacgtttattcgtgtgcaggaacaagaaaaccgcatcttcaacaacctgtaatctcccaacgctggcgtggagcaacacgccagcgttatcccatcccactcatcgcatcgcctaaatggaaaattggcagatacattgccaccaccagcgtaccaataattcctcccgttatgatcagcaacgccggttccagtaaggctgcgaggttatccgccagcgccattgtgttttcccgatgatgatgggcgaggttgtctaacatgagatccagagagccggatgcctctcctgttctcactaattgcaaacagagcgggctaaactcaccggtattttttagcgccagccagatgggttgaccgttactgatatcgtgctggatttgtgtcagaagttgcacccagtacgggcagcgcattgtttctctgacgctctctacgccctgtaaaaaagtaatgcctgcactttgtgtcagcgccagaatcgtaaagatctgcgtgagtttttgtccccgcatcagtgaacccataatcgggatgcgtaacagcaatttctgccgcactataagccaggtcggtcggcgcatcagcaacttattggctatcgccagcagaaagccgaacaacaccagcagccagctccattcgccactaaagtctgccagcgtcatgatcccctgcgttagtgccggtagtggggtgttgaaggtcttatagatagcggcaaactccggcagaacaaaatgcagcattgccacaaccaccatgattgccatcgctaaaatgatgatgggataacgtaacgctgatttcactttgtcggtcaactgacgctgggctttttgctgacgcgccagttcaaagcagcattcatccagcttaccggtcagttcacccgtgcggatcatcgcctgatagagcggcggaaatacctctgaccagggtaataaggcattggaaaaagcaatgccctgttcgagatcgtgcgccagcgattgcagcaacgcttgccattgcttactgggatgctgttccgccagcagagccagcccttcagaaagcgttaaccctgctttgagtagcgtcgccagttgatgaatgacttccgcgcttttatctcctcgccactgcgcagaattgatggcgattcgcttcaggcttagtggggtaaccatctgttgctgtagtgccataagcagtaaagtacggctctctgcccatagcatcccatcttgcgcattgccgtcgccggttatgccatgccagcgccagagttgcttactcgccatgcggcatccccagtacgcggattaactcttcaaaggtggttaagccttgctctacggccaggcagccgttttcaaaaagcgtacgcatacccgcctgtcgtgcgtgcgtttccagcgattcaacgtcggtattagcggaaataagctgacgaatgaccggcgttatgggcagaacttcaaataaggccgtacgaccataaaaaccgtggtagcaatgtacacaaccgggtgcctgccagtggggcagcggcgatggccatacattgtctggaatgtggatgggctccccttgctgccggcgacaatgtgggcaaagtttgcgtaccagacgctgggctattaccagcgtaagcgccgatgatagcatccagcgggcgacccccatttgctgtaaacgtaccagcgtttcgcaggtggaattagtgtgtagggtagacaacaccaggtgaccagtttgcgccgctttaatagcgatctctgctgtttcgccatcgcggatctctccgatcatgatgacgtcaggatcctggcgcaataacgcacgcaaaacgccctgaaaggtgagtccggcacgcggatggatttgcgtctggtttagtccggctatggggatctcaactggatcttcgacgctacaaatattaatgtcagcggtattcagcttttgcagggcactataaagcgtgaccgttttgccgctgccggtagggccagttaccagcaccagtccctgtggttgttgcaaggcatgagcaaagtccgccagttgtaacggctgcattccaagcgtgttgacatccagtgcctgacccacctgctgtaacaaccttaataccaccttttcaccaccccgacatggtaaggtcgcaatacgaaatgagacggcgtttcctgccagttcgacagtgaattgcccgtcctgcggcaggcgatgttccgcaatatccaggtttcccagcacttttaatctggcggttaatgcgactccggcatccggtgaaacatccggtaaaggatgcaatacgccgtcgatacgcaagcggatgcggtaggcattgtccgctggttcgatatgaatatcagacgcgcgttgttccagcgcagattgtaacgttcgagttagcaactctgctttgggctgatgcttctcctgaacagctacgggcaatgtctgttgtgtgcgactggcgtgaccttccatttgttggcgcgtccagcaggtgatctcaatacgtttggtggtagcgaaatgcaatgcgtccagtagctcatgcgaaggtgcatcgactaccgcaacatgaaccacctcttcgctggcatccagcaagactccatgataacgcagacacagggcagtgagctgtggaatattcattgccgctccttagttggcgtcatcaaagcggaagacatcttcgcaggcttgctgcaatgcgctgtcactttgaatattgcagttgcgcgtccagccggtgacgccgtttgcgttatcccaacccggtgtcatgacgacgcttagcccattgagactttcttgcccggtcagcgacaccacgccctttgccacactcatggctgaaacatagcgggtggtggtaggcgagggaatgccattgctgccaccgtcgcaggtatctaatccaccatgttccagcgcgcacaactctacggcggtacggtaaggcacaaaggtttgtagcatgtcggtgagtgcggctttgcgcaggtagttttgataagcgggaataccaatggcgcttaaaatggcaatgatgccaataaccaccatcagttcgataagtgtaaaaccgcgttgcttgtccatctgtttcgctccttgatttggttggcgctactttggcaaacgccatcagcacaggcgaggggcaaaaaacgaaacgggaaagcagattccgaggttttttatttcgttgcagcgaaagacaagaaatttgcgaggcgttacgaagaaagttggggaaggggagattatccgcccgcgatggagcggataaatctgtcaactattagcgaaaacgcattgaaaggtcgagtgcttgtacgtgtttagttagcgcaccgacggagataaagtccacgcccgtttcggcaaattcacgcagtgttttgtcagtgacgttgccagacacttccagtagcgccttgccgttggtgcgtttgacggcttcgcgcatctgttctgtttcgaagttatccagcatgatgatatcggctcctgctttcagggcttcatcaagttcttccagattctctacttcgacttctactggcgcatccgggtgcagccaggacgctttttcgaccgcctggcgcactgagccggaggcaataatatggttttctttgatcaggaaggcatcagaaagccccagacggtgattcgctccgccgccgcaaagtaccgcgtatttcagagctgaacgcaggccgggtaaggttttgcgcgtatccaacaactgcgtgttggtgccttccagcaattcgacatagtggcgtaccttactggcaactcctgaaagggtttgcacaaaattaagcgcagtgcgttcgcccgttaacagcacgcgggatgggccttcaagttcgaacaaggattgattggcattgatgacatcgccgtcatccacatgccagattatggtgacatcgtcgcctgccagttgaataaacacctcttcaacccagcgtttgccgcaaaagacgccattctcgcgggtgatcaccgtggcatgagagcgagaattttccggtaaaagttttgccgtaatatcattgttggcatcgactgttccgcctaaatcttcccgcagcgcctgggccaccgcgccggggatatcgagattaatgcgttccagcagctcgtcacgtcgggtgtcagggttatagcggcgaggcggcatgttaaaactccagatagctaacgaatcataaggtagaaacatgctactctgaaccgggtattagcaccacatataaggagatcctgcatgttgttagaacaggggtggctggttggcgcgcgccgcgttccctcaccacattacgattgccgcccggatgacgaaacacccaccctgctggtggtgcacaatattagcctgccgccaggcgagtttggcggtccgtggatcgacgcattattcactggaactattgatccgcaggcacatcctttctttgctgagatcgcccatttgcgcgtctccgctcactgtttgattcgccgtgatggtgaaatagtccagtatgttcctttcgataaacgtgcatggcatgcgggagtctctcagtatcaggggcgcgaacgctgcaatgatttttctattgggattgagcttgaaggcaccgatacgctggcgtataccgatgcgcagtatcaacagcttgcggcggttacgcgggcactgattgattgctatccggatatcgctaaaaacatgacgggccattgtgatattgcgccggatcggaaaaccgatcccggtcctgcatttgattgggcacggtttcgtgtgctggtcagcaaggagacaacatgacgctatttacaaccttactggtgttaattttcgagcgcctgtttaagttgggcgagcactggcagcttgatcatcgtcttgaagcgttctttcggcgggtgaaacatttttctctcgggcgcacgttaggcatgaccattattgcgatgggcgtgacttttttactgttacgcgcattgcagggagtattgttcaacgttcccacgctactggtgtggctgctgattggtttgctgtgtattggcgcaggtaaagttcgtcttcattatcatgcttatctgacagctgcttcacgtaatgatagccatgcccgtgccacgatggctggcgaactcaccatgattcacggcgtcccggcaggctgcgacgaacgtgagtatttgcgtgagctgcaaaatgcattgctgtggattaactttcgtttttatcttgcaccgctgttctggctgattgtggggggaacctggggacccgttacgctgatggggtatgcgtttttgcgtgcatggcaatactggctggcgcgatatcagacgccgcatcatcgtttacagtccggcattgatgccgtgcttcatgtactggattgggtgccggttcgtcttgcgggtgtggtatatgccttgatcggtcatggtgagaaagcgttaccggcctggtttgcttcgctgggtgatttccatacttcgcagtatcaggtgttaacgcgtctggcgcagttctctctggcgcgtgaaccgcatgtcgataaggtggagacgccgaaggcagcggtttcaatggcgaagaaaacctcgttcgtggtcgtggtggtgattgcactactgacgatttacggggcgttggtgtaaagattattgccctcaccctgtacgggtgagggcgtagagagattaatgcgcttttacggctttggcggttttctctttaaacagatagccgatacctaacacgatcagccataccgggatcaggtataccgaaatcgccattcctggggtcatcagcataatcaccagtaccgccgccataaacagcaggcagatccagttacccagcggataaagcagagcagggaagcgagttaccacgccttgttcctgcttggcgcgacggaatttcatatgcgccaggctaatcatcgcccagttgattaccagtgcagataccaccagcgccattaacagtccgaaagcggactctggggcaaggtagttaatcagtacgcacaacgccgttaccagtgcagacaccagaatggtatttactggtacaccacgtttatcgacagacgccagcgcttttggcgcattaccctgttgtgccagaccaaacagcatacggctgttgcaatatacgcagctgttgtacacggagagcgccgcagtcagtaccacgatgttcagcgcattcgccacaaaggtatcgcctaactcgtggaagatcagcacaaacggactggtatcggcggtaacgcgggtccacggcatcagtgagagcagaacggctaacgaaccaatatagaaaatcaggatgcggtagataacctggttagttgctttcggtatactttgctccgggttatcagcttctgctgcggtgatccccaccagttccagaccaccgaacgagaacatgataatcgccatcatcatcaccagcccggtgaagccgtgcggcaggaaaccaccctgatcccacaggttgctaacggtcgcctgcgggccgccgttgccactgaatagcagccagccgccgaagatgatcatcgctaccaccgcgataactttgataatggcaaaccagaactccatctcgccaaacactttaacgttggtcaggttgatggcgttaatcaccacaaagaatacggcggcagaaacccaggtggggatttccggataccagaactgaatgtatttacccacggcagtcagctcagccatggcaactaaaacgtacagtacccagtagttccagccagaggcgaaaccggcaaaactgccccagtatttataagcaaagtggctaaaggagcctgcgacaggttcttcgaccaccatttcacccagctgacgcatgatcagaaaggcgataaaaccagcaatggcgtaacccaggataatccctggccctgcggactgtattacggaggcgctacccaggaataacccggtccctatcgcgccacccagcgcgataagctgaatatggcggtttttaaggccgcgctttagctgctcgccgtgctgttgaccttccatcatgaaacctcgtgcggtggttgtttttttgatctacgcagtgatgcgtgtgtaagtttgcaattccgtttgttgtattaatttgtttacatcaaagaagtttgaattgttacaaaaagacttccgtcagatcaagaataatggtatgcggcagcgaatgcacccgctttatgcatggttgaagatgagttgcttaaaaagaaaccgtttgtaaagctcagcctcaacccctctcaatatgtagaatgaatttaaattcgttttaattgaattaaaaatcacaaaattggtaagtgaatcggttcaattcggatttttatagtttaataatcgttaaaaaactcctttcctacgtaaagtctacatttgtgcatagttacaactttgaaacgttatatatgtcaagttgttaaaatgtgcacagtttcatgatttcaatcaaaacctgtatggacataaggtgaatactttgttactttagcgtcacagacatgaaattggtaagaccaattgacttcggcaagtggcttaagacaggaactcatggcctacagcaaaatccgccaaccaaaactctccgatgtgattgagcagcaactggagtttttgatcctcgaaggcactctccgcccgggcgaaaaactcccaccggaacgcgaactggcaaaacagtttgacgtctcccgtccctccttgcgtgaggcgattcaacgtctcgaagcgaagggcttgttgcttcgtcgccagggtggcggcacttttgtccagagcagcctatggcaaagcttcagcgatccgctggtggagctgctctccgaccatcctgagtcacagtatgacttgctcgaaacacgacacgccctggaaggtatcgccgcttattacgccgcgctgcgtagtaccgatgaagacaaggaacgcatccgtgaactccaccacgccatagagctggcgcagcagtctggcgatctggacgcggaatcaaacgccgtactccagtatcagattgccgtcaccgaagcggcccacaatgtggttctgcttcatctgctaaggtgtatggagccgatgttggcccagaatgtccgccagaacttcgaattgctctattcgcgtcgcgagatgctgccgctggtgagtagtcaccgcacccgcatatttgaagcgattatggccggtaagccggaagaagcgcgcgaagcatcgcatcgccatctggcctttatcgaagaaattttgctcgacagaagtcgtgaagagagccgccgtgagcgttctctgcgtcgtctggagcaacgaaagaattagtgatttttctggtaaaaattatccagaagatgttgtaaatcaagcgcatataaaagcgcggcaactaaacgtagaacctgtcttattgagctttccggcgagagttcaatgggacaggttccagaaaactcaacgttattagatagataaggaataacccatgtcagaacgtttcccaaatgacgtggatccgatcgaaactcgcgactggctccaggcgatcgaatcggtcatccgtgaagaaggtgttgagcgtgctcagtatctgatcgaccaactgcttgctgaagcccgcaaaggcggtgtaaacgtagccgcaggcacaggtatcagcaactacatcaacaccatccccgttgaagaacaaccggagtatccgggtaatctggaactggaacgccgtattcgttcagctatccgctggaacgccatcatgacggtgctgcgtgcgtcgaaaaaagacctcgaactgggcggccatatggcgtccttccagtcttccgcaaccatttatgatgtgtgctttaaccacttcttccgtgcacgcaacgagcaggatggcggcgacctggtttacttccagggccacatctccccgggcgtgtacgctcgtgctttcctggaaggtcgtctgactcaggagcagctggataacttccgtcaggaagttcacggcaatggcctctcttcctatccgcacccgaaactgatgccggaattctggcagttcccgaccgtatctatgggtctgggtccgattggtgctatttaccaggctaaattcctgaaatatctggaacaccgtggcctgaaagatacctctaaacaaaccgtttacgcgttcctcggtgacggtgaaatggacgaaccggaatccaaaggtgcgatcaccatcgctacccgtgaaaaactggataacctggtcttcgttatcaactgtaacctgcagcgtcttgacggcccggtcaccggtaacggcaagatcatcaacgaactggaaggcatcttcgaaggtgctggctggaacgtgatcaaagtgatgtggggtagccgttgggatgaactgctgcgtaaggataccagcggtaaactgatccagctgatgaacgaaaccgttgacggcgactaccagaccttcaaatcgaaagatggtgcgtacgttcgtgaacacttcttcggtaaatatcctgaaaccgcagcactggttgcagactggactgacgagcagatctgggcactgaaccgtggtggtcacgatccgaagaaaatctacgctgcattcaagaaagcgcaggaaaccaaaggcaaagcgacagtaatccttgctcataccattaaaggttacggcatgggcgacgcggctgaaggtaaaaacatcgcgcaccaggttaagaaaatgaacatggacggtgtgcgtcatatccgcgaccgtttcaatgtgccggtgtctgatgcagatatcgaaaaactgccgtacatcaccttcccggaaggttctgaagagcatacctatctgcacgctcagcgtcagaaactgcacggttatctgccaagccgtcagccgaacttcaccgagaagcttgagctgccgagcctgcaagacttcggcgcgctgttggaagagcagagcaaagagatctctaccactatcgctttcgttcgtgctctgaacgtgatgctgaagaacaagtcgatcaaagatcgtctggtaccgatcatcgccgacgaagcgcgtactttcggtatggaaggtctgttccgtcagattggtatttacagcccgaacggtcagcagtacaccccgcaggaccgcgagcaggttgcttactataaagaagacgagaaaggtcagattctgcaggaagggatcaacgagctgggcgcaggttgttcctggctggcagcggcgacctcttacagcaccaacaatctgccgatgatcccgttctacatctattactcgatgttcggcttccagcgtattggcgatctgtgctgggcggctggcgaccagcaagcgcgtggcttcctgatcggcggtacttccggtcgtaccaccctgaacggcgaaggtctgcagcacgaagatggtcacagccacattcagtcgctgactatcccgaactgtatctcttacgacccggcttacgcttacgaagttgctgtcatcatgcatgacggtctggagcgtatgtacggtgaaaaacaagagaacgtttactactacatcactacgctgaacgaaaactaccacatgccggcaatgccggaaggtgctgaggaaggtatccgtaaaggtatctacaaactcgaaactattgaaggtagcaaaggtaaagttcagctgctcggctccggttctatcctgcgtcacgtccgtgaagcagctgagatcctggcgaaagattacggcgtaggttctgacgtttatagcgtgacctccttcaccgagctggcgcgtgatggtcaggattgtgaacgctggaacatgctgcacccgctggaaactccgcgcgttccgtatatcgctcaggtgatgaacgacgctccggcagtggcatctaccgactatatgaaactgttcgctgagcaggtccgtacttacgtaccggctgacgactaccgcgtactgggtactgatggcttcggtcgttccgacagccgtgagaacctgcgtcaccacttcgaagttgatgcttcttatgtcgtggttgcggcgctgggcgaactggctaaacgtggcgaaatcgataagaaagtggttgctgacgcaatcgccaaattcaacatcgatgcagataaagttaacccgcgtctggcgtaagaggtaaaagaataatggctatcgaaatcaaagtaccggacatcggggctgatgaagttgaaatcaccgagatcctggtcaaagtgggcgacaaagttgaagccgaacagtcgctgatcaccgtagaaggcgacaaagcctctatggaagttccgtctccgcaggcgggtatcgttaaagagatcaaagtctctgttggcgataaaacccagaccggcgcactgattatgattttcgattccgccgacggtgcagcagacgctgcacctgctcaggcagaagagaagaaagaagcagctccggcagcagcaccagcggctgcggcggcaaaagacgttaacgttccggatatcggcagcgacgaagttgaagtgaccgaaatcctggtgaaagttggcgataaagttgaagctgaacagtcgctgatcaccgtagaaggcgacaaggcttctatggaagttccggctccgtttgctggcaccgtgaaagagatcaaagtgaacgtgggtgacaaagtgtctaccggctcgctgattatggtcttcgaagtcgcgggtgaagcaggcgcggcagctccggccgctaaacaggaagcagctccggcagcggcccctgcaccagcggctggcgtgaaagaagttaacgttccggatatcggcggtgacgaagttgaagtgactgaagtgatggtgaaagtgggcgacaaagttgccgctgaacagtcactgatcaccgtagaaggcgacaaagcttctatggaagttccggcgccgtttgcaggcgtcgtgaaggaactgaaagtcaacgttggcgataaagtgaaaactggctcgctgattatgatcttcgaagttgaaggcgcagcgcctgcggcagctcctgcgaaacaggaagcggcagcgccggcaccggcagcaaaagctgaagccccggcagcagcaccagctgcgaaagcggaaggcaaatctgaatttgctgaaaacgacgcttatgttcacgcgactccgctgatccgccgtctggcacgcgagtttggtgttaaccttgcgaaagtgaagggcactggccgtaaaggtcgtatcctgcgcgaagacgttcaggcttacgtgaaagaagctatcaaacgtgcagaagcagctccggcagcgactggcggtggtatccctggcatgctgccgtggccgaaggtggacttcagcaagtttggtgaaatcgaagaagtggaactgggccgcatccagaaaatctctggtgcgaacctgagccgtaactgggtaatgatcccgcatgttactcacttcgacaaaaccgatatcaccgagttggaagcgttccgtaaacagcagaacgaagaagcggcgaaacgtaagctggatgtgaagatcaccccggttgtcttcatcatgaaagccgttgctgcagctcttgagcagatgcctcgcttcaatagttcgctgtcggaagacggtcagcgtctgaccctgaagaaatacatcaacatcggtgtggcggtggataccccgaacggtctggttgttccggtattcaaagacgtcaacaagaaaggcatcatcgagctgtctcgcgagctgatgactatttctaagaaagcgcgtgacggtaagctgactgcgggcgaaatgcagggcggttgcttcaccatctccagcatcggcggcctgggtactacccacttcgcgccgattgtgaacgcgccggaagtggctatcctcggcgtttccaagtccgcgatggagccggtgtggaatggtaaagagttcgtgccgcgtctgatgctgccgatttctctctccttcgaccaccgcgtgatcgacggtgctgatggtgcccgtttcattaccatcattaacaacacgctgtctgacattcgccgtctggtgatgtaagtaaaagagccggcccaacggccggcttttttctggtaatctcatgaatgtattgaggttattagcgaatagacaaatcggttgccgtttgttgtttaaaaattgttaacaattttgtaaaataccgacggatagaacgacccggtggtggttagggtattacttcacataccctatggatttctgggtgcagcaaggtagcaagcgccagaatccccaggagcttacataagtaagtgactggggtgagggcgtgaagctaacgccgctgcggcctgaaagacgacgggtatgaccgccggagataaatatatagaggtcatgatgagtactgaaatcaaaactcaggtcgtggtacttggggcaggccccgcaggttactccgctgccttccgttgcgctgatttaggtctggaaaccgtaatcgtagaacgttacaacacccttggcggtgtttgcctgaacgtcggctgtatcccttctaaagcactgctgcacgtagcaaaagttatcgaagaagccaaagcgctggctgaacacggtatcgtcttcggcgaaccgaaaaccgatatcgacaagattcgtacctggaaagagaaagtgatcaatcagctgaccggtggtctggctggtatggcgaaaggccgcaaagtcaaagtggtcaacggtctgggtaaattcaccggggctaacaccctggaagttgaaggtgagaacggcaaaaccgtgatcaacttcgacaacgcgatcattgcagcgggttctcgcccgatccaactgccgtttattccgcatgaagatccgcgtatctgggactccactgacgcgctggaactgaaagaagtaccagaacgcctgctggtaatgggtggcggtatcatcggtctggaaatgggcaccgtttaccacgcgctgggttcacagattgacgtggttgaaatgttcgaccaggttatcccggcagctgacaaagacatcgttaaagtcttcaccaagcgtatcagcaagaaattcaacctgatgctggaaaccaaagttaccgccgttgaagcgaaagaagacggcatttatgtgacgatggaaggcaaaaaagcacccgctgaaccgcagcgttacgacgccgtgctggtagcgattggtcgtgtgccgaacggtaaaaacctcgacgcaggcaaagcaggcgtggaagttgacgaccgtggtttcatccgcgttgacaaacagctgcgtaccaacgtaccgcacatctttgctatcggcgatatcgtcggtcaaccgatgctggcacacaaaggtgttcacgaaggtcacgttgccgctgaagttatcgccggtaagaaacactacttcgatccgaaagttatcccgtccatcgcctataccgaaccagaagttgcatgggtgggtctgactgagaaagaagcgaaagagaaaggcatcagctatgaaaccgccaccttcccgtgggctgcttctggtcgtgctatcgcttccgactgcgcagacggtatgaccaagctgattttcgacaaagaatctcaccgtgtgatcggtggtgcgattgtcggtactaacggcggcgagctgctgggtgaaatcggcctggcaatcgaaatgggttgtgatgctgaagacatcgcactgaccatccacgcgcacccgactctgcacgagtctgtgggcctggcggcagaagtgttcgaaggtagcattaccgacctgccgaacccgaaagcgaagaagaagtaatttttcgtttgccggaacatccggcaattaaaaaagcggctaaccacgccgctttttttacgtctgcaatttacctttccagtcttcttgctccacgttcagagagacgttcgcatactgctgaccgttgctcgttattcagcctgacagtatggttactgtcgtttagacgttgtgggcggctctcctgaactttctcccgaaaaacctgacgttgttcaggtgatgccgattgaacacgctggcgggcgttatcacgttgctgttgattcagtgggcgctgctgtactttttccttaaacacctggcgctgctctggtgatgcggactgaatacgctcacgcgctgcgtctcttcgctgctggttctgcgggttagtctgcattttctcgcgaaccgcctggcgctgctcaggcgaggcggactgaatgcgctcacgcgctgcctctcttcgctgctggatcttcgggttagtctgcattctctcgcgaactgcctggcgctgctcaggcgaggcggactgataacgctgacgagcggcgtccttttgttgctgggtcagtggttggcgacggctgaagtcgtggaagtcgtcatagctcccatagtgttcagcttcattaaaccgctgtgccgctgcctgacgttgggtatctcgtgtaatgactggtgcggcgtgtgttcgttgctgaaactgatttgctgccgcctgacgctggctgtcgcgcgttggggcaggtaattgcgtggcgctcattccgccgttgacatcggtttgatgaaaccgctttgccatatcctgatcatgatagggcacaccattacggtagtttggattgtgccgccatgccatattcttatcagtaagatgctcaccggtgatacggttgaaattgttgacgtcgatattgatgttgtcgccgttgtgttgccagccattaccgtcacgatgaccgccatcgtggtgatgataatcatcattgtcatgatgatgatggtcatgatcgtcgtcgtcccagtcgatgctgctgaatagtgcgtacgtggtagcaacgcccatgctatagccgaatccgcgtacaaagctgtcaacaaacggttctccggctggtggtggcagataaaccggcggatacgcagtattggcccagttcccgtaaaccacggttgggttgtagttgggaatatagaccacatcaggattggcgggctcaatggaaatgacggttgttgccggctctgtaatgacggggttggcagttaaaactgtattggatggtatgacgggtgccgtgactgtctgttttaccggtacagctttcttcgttgtggtaataactttctgttcggttgatgacttcagcgagccggtttgttgcgccagttgccgcaatcgctgtaccgagtccatcacgtcctgcggctgggccagaaaagcatcgcccaggttttgcacccattgcgggttttcgcccatcaatgccatcaattgtggaaaggccaccagtgatttaacgctggcgtcccacggctggtcagataccgcctgaatagcagcatcgccttgtttaagtggattatcgtgcgaccattgcactgcttgagcaacgtttgtcggataggttgatgccatcagcacctgcgaaagtagggcgtcgggatacagcgcgacgggcgcgacccattgatctatttgtgcagtgctgaatgcggatttgacgacggcgggtgttacgggaggtgcggaaaccgttgcaggaaacgtaaccgcggcagcgtcagacacagccagttgtgtcgattgcggttccacaggcgcttccactgtgcggctttttatatatagcccggtagaggcggcacaaagcccggcactgcaaattagcgccagcacatggggtttaaacggcaaagtcattttcataattcggatctcaaggaaatcgcaatggtcggcgaactgccacccgcaggtgctgtgaatccgagtataaagaggcggtagtttaaattttgactaatcttgggattcgttgagaaaggtgattatcaccatgcgaattaacgaagtttttacggagggaaacaatctctagaccatccttaacgattcagccacttttttatgttgcttttttgtaaacagattaacacctcgtcaaaatcctgctattctgcccgttgcggtactgggcatttaccctacaaactgctgtctcacaggagcgtgaagagaatcgcctgccgcactatgacaatgagagcgaggagaaccgtcgtgctagaagaataccgtaagcacgtagctgagcgtgccgctgaggggattgcgcccaaacccctggatgcaaaccaaatggccgcacttgtagagctgctgaaaaacccgcccgcgggcgaagaagaattcctgttagatctgttaaccaaccgtgttcccccaggcgtcgatgaagccgcctatgtcaaagcaggcttcctggctgctatcgcgaaaggcgaagccaaatcccctctgctgactccggaaaaagccatcgaactgctgggcaccatgcagggtggttacaacattcatccgctgatcgacgcgctggatgatgccaaactggcacctattgctgccaaagcactttctcacacgctgctgatgttcgataacttctatgacgtagaagagaaagcgaaagcaggcaacgaatatgcgaagcaggttatgcagtcctgggcggatgccgaatggttcctgaatcgcccggcgctggctgaaaaactgaccgttactgtcttcaaagtcactggcgaaactaacaccgatgacctttctccggcaccggatgcgtggtcacgcccggatatcccactgcacgcgctggcgatgctgaaaaacgcccgtgaaggtattgagccagaccagcctggtgttgttggtccgatcaagcaaatcgaagctctgcaacagaaaggtttcccgctggcgtacgtcggtgacgttgtgggtacgggttcttcgcgtaaatccgccactaactccgttctgtggtttatgggcgatgatattccacatgtgccgaacaaacgcggcggtggtttgtgcctcggcggtaaaattgcacccatcttctttaacacgatggaagacgcgggtgcactgccaatcgaagtcgacgtctctaacctgaacatgggcgacgtgattgacgtttacccgtacaaaggtgaagtgcgtaaccacgaaaccggcgaactgctggcgaccttcgaactgaaaaccgacgtgctgattgatgaagtgcgtgctggtggccgtattccgctgattatcgggcgtggcctgaccaccaaagcgcgtgaagcacttggtctgccgcacagtgatgtgttccgtcaggcgaaagatgtcgctgagagcgatcgcggcttctcgctggcgcaaaaaatggtaggccgtgcctgtggcgtgaaaggcattcgtccgggcgcgtactgtgaaccgaaaatgacttctgtaggttcccaggacaccaccggcccgatgacccgtgatgaactgaaagacctggcgtgcctgggcttctcggctgacctggtgatgcagtctttctgccacaccgcggcgtatccgaagccagttgacgtgaacacgcaccacacgctgccggacttcattatgaaccgtggcggtgtgtcgctgcgtccgggtgacggcgtcattcactcctggctgaaccgtatgctgctgccggataccgtcggtaccggtggtgactcccatacccgtttcccgatcggtatctctttcccggcgggttctggtctggtggcgtttgctgccgcaactggcgtaatgccgcttgatatgccggaatccgttctggtgcgcttcaaaggcaaaatgcagccgggcatcaccctgcgcgatctggtacacgctattccgctgtatgcgatcaaacaaggtctgctgaccgttgagaagaaaggcaagaaaaacatcttctctggccgcatcctggaaattgaaggtctgccggatctgaaagttgagcaggcctttgagctaaccgatgcgtccgccgagcgttctgccgctggttgtaccatcaagctgaacaaagaaccgatcatcgaatacctgaactctaacatcgtcctgctgaagtggatgatcgcggaaggttacggcgatcgtcgtaccctggaacgtcgtattcagggcatggaaaaatggctggcgaatcctgagctgctggaagccgatgcagatgcggaatacgcggcagtgatcgacatcgatctggcggatattaaagagccaatcctgtgtgctccgaacgacccggatgacgcgcgtccgctgtctgcggtacagggtgagaagatcgacgaagtgtttatcggttcctgcatgaccaacatcggtcacttccgtgctgcgggtaaactgctggatgcgcataaaggtcagttgccgacccgcctgtgggtggcaccgccaacccgtatggacgccgcacagttgaccgaagaaggctactacagcgtcttcggtaagagtggtgcgcgtatcgagatccctggctgttccctgtgtatgggtaaccaggcgcgtgtggcggacggtgcaacggtggtttccacctctacccgtaacttcccgaaccgtctgggtactggcgcgaatgtcttcctggcttctgcggaactggcggctgttgcggcgctgattggcaaactgccgacgccggaagagtaccagacctacgtggcgcaggtagataaaacagccgttgatacttaccgttatctgaacttcaaccagctttctcagtacaccgagaaagccgatggggtgattttccagactgcggtttaaaaagtcagcgcacgcgctgcgcataaacgacacaatgcccggtgaatgagattcccgggcatttttttatttctaaaccatcgccgttccgctgtttttctccggtaaggctgcgataattacatcaatggcgcaatgcgatttcggtgcattgccgggagcagaggaacacactatggattacgaatttctgcgcgatattaccggagtggtaaaggtgcgtatgtccatggggcatgaagtggtcgggcactggtttaatgaagaggtgaaagaaaacctggccttgcttgatgaagtggaacaagcagcgcacgcactgaaaggtagcgaacggtcctggcaacgggcagggcatgaatacaccctgtggatggacggtgaagaggtgatggttcgcgccaatcaactggaattcgctggcgatgaaatggaagaggggatgaactactacgacgaagaaagcctgtcgctatgcggcgttgaggattttctgcaggtcgtggcggcttaccgcaatttcgtgcagcagaagtaaataaatctggcggagcctgggagctccgccagagccgttaaacagctggcatattgcgcccgtaataaatctcgcgcatttctttccacagcgcagcggtaatttcctggcgctcgctgtcggttaagtcttccggtttggtgtggaacatgtagtgcttaaggtcgaactctttaagcaacatcttggtatggaagatattttcctgatagacgttcacatccaccatgtcatacagcgccttcatatcgtcagacataaagttctgaatcgaattaatctcatggtcgataaagtgcttcataccgttaatgtcgcgggtaaaaccgcgcacgcgataatcaatggttacgatatcggactcaagctggtggatcaggtaattcagcgccttcagcggagaaatcacgccgcaggtagagacttcaatatcggcgcggaaggtacataaaccgccttcaggatgactttccgggtaggtatgtacgcaaatatgacttttatcaagatgggcaacgaccgtttctggcagtgggccggggtgttctgttttgtcgatgagtttcgggtcaaccggttcttcactcaccagaatagtgacgctggcaccctgtggttcgtaatcctggcgggcgatgttaagaatattagccccgataatggaacaggtttctgacaggatttcggtcagacggttggcattatagagttcatcgatataagcaatataaccgtcgcgctcttcggcagttttggcgtagcagatatcgtaaatacaaaaactcagacttttggtcagattattaaagccatgcagtttcagttttttcaatttcttatcttctccttaggacggctgtgaagccagtgcgtcttgcagatactgaggtaaggcaaaagctgccgtatggattgccggattgtaataacggcatttcaggccagaggcgagaaaacgcgcctgaataatttcggttgagagatggcgtaaggcgtcgttatctgtcgcccatgcaaaagtcatgataccgccgtaataggtcgggatcgccgcctgataaaagccaacgtcgctgaagtaatggctgagtttgcgatggctgtcgatggcttcttcctgctgtaaaaagcagacgccgttttgtgcgacgaagataccgccaggattcaggcaacgtttgcagccttcataaaatgccgaagtgaaaaggctttcgccgggaccgataggatcggtgcagtcggagataatgacatcaaaggtctggctggtttgattaacgaaattgacgccatcgtcgatcaccagcttaaagcgcggatcgtcgtagctaccggcgttatggttgggtagatactgacggcagaacgatacgacacccgcatcgatttccaccatcgtgattgactcaacgtttttatgtcgggttacttcacgcagcatggcaccgtcgccgccgccgataatcagcacatgtttcgcgtgaccatgggccagtagcggaacatgggtcatcatctcatgatagataaactcgtcgcgctcggtggtttgtactacgccatccagcgccattacgcgaccaaatgcagcgttctcaaaaatgatcagatcctggtgatcggtcttttcatgatacagaacgttatctaccgcaaagtactgcccaaactggtcgtgtagcgtttcatgccactgttttttttcggccatgggttgatacctcctttgttaacacccgtaaaaaaagggcgcaacataatagctaacattgaccgcggatgcacggtcaatatttctacaaaaaggtatcagggattatttgacgtaggcaagcaggcttaaggaatcgcgggccagggctttgcattttttagcgacgggaatgccaatgccgctgagatcgcggtagctgtcttcaccgagggctttcatgtcgaaggtgtcgtaattactgaggtcccactggttttgctgagcgaaaaagaccagtgcgcgacgaatttgcccgttaggtaagttctggtaaccacaatcgttcttcagaaagacaaaaactgccgttaaatcggccatatcttcggcttcagactcgctgagcgcgtaactgtttgcgcagacggccatcaggctgccgaataacactgttctgaaaaacgtcttcattgcttctaccaggggcttaaagaagataaacgttagcacactgcgagcgaggcgacgaccattattgtcgattaaattgtgtctgcggcttgaccttcccgtaaggggaaggactatgctcaacgtttgattttgtttcgcctgcttaagaataaggaaataactatgcaacgtcgtgatttcttaaaatattccgtcgcgctgggtgtggcttcggctttgccgctgtggagccgcgcagtatttgcggcagaacgcccaacgttaccgatccctgatttgctcacgaccgatgcccgtaatcgcattcagttaactattggcgcaggccagtccacctttggcgggaaaactgcaactacctggggctataacggcaatctgctggggccggcggtgaaattacagcgcggcaaagcggtaacggttgatatctacaaccaactgacggaagagacaacgttgcactggcacgggctggaagtaccgggtgaagtcgacggcggcccgcagggaattattccgccaggtggcaagcgctcggtgacgttgaacgttgatcaacctgccgctacctgctggttccatccgcatcagcacggcaaaaccgggcgacaggtggcgatggggctggctgggctggtggtgattgaagatgacgagatcctgaaattaatgctgccaaaacagtggggtatcgatgatgttccggtgatcgttcaggataagaaatttagcgccgacgggcagattgattatcaactggatgtgatgaccgccgccgtgggctggtttggcgatacgttgctgaccaacggtgcaatctacccgcaacacgctgccccgcgtggttggctgcgcctgcgtttgctcaatggctgtaatgcccgttcgctcaatttcgccaccagcgacaatcgcccgctgtatgtgattgccagcgacggtggtctgctacctgaaccagtgaaggtgagcgaactgccggtgctgatgggcgagcgttttgaagtgctggtggaggttaacgataacaaaccctttgacctggtgacgctgccggtcagccagatggggatggcgattgcgccgtttgataagcctcatccggtaatgcggattcagccgattgctattagtgcctccggtgctttgccagacacattaagtagcctgcctgcgttaccttcgctggaagggctgacggtacgcaagctgcaactctctatggacccgatgctcgatatgatggggatgcagatgctaatggagaaatatggcgatcaggcgatggccgggatggatcacagccagatgatgggccatatggggcacggcaatatgaatcatatgaaccacggcgggaagttcgatttccaccatgccaacaaaatcaacggtcaggcgtttgatatgaacaagccgatgtttgcggcggcgaaagggcaatacgaacgttgggttatctctggcgtgggcgacatgatgctgcatccgttccatatccacggcacgcagttccgtatcttgtcagaaaatggcaaaccgccagcggctcatcgcgcgggctggaaagataccgttaaggtagaaggtaatgtcagcgaagtgctggtgaagtttaatcacgatgcaccgaaagaacatgcttatatggcgcactgccatctgctggagcatgaagatacggggatgatgttagggtttacggtataaaaagaccgtattcggaaatatgcccggatctctccgggcattaaactgatgacaaacgcaaatctgcctgatgcgctacgcttatcaggcctacgctagctgtgcaatccattgattttgcacaattttgtaggctggataaggcgttcacgccgcatccggcatgaacaacgcgcacgttgtcagcaatctgagcaagtcttacttcacatcatccggcagcgcataagccacaatatagtcgcccatcttcgtaccaaatgaaccgtgaccgcctgcggagatcaccacatactgcttaccattcacttcataggtcattggcgtagcctgaccacccgctggtaaacgaccctgccacagtttttcaccgttgctcatgttgtaagcgcgcaggtagttatctgccgtagcggcgataaacagcacgttacccgccgtggagattggcccgcccagcatcggcatacccatattgaacggcaccggaaccggcatcgggaacggcatactgtcctgcggcgtaccaatacgtttcttccacaccacttcattagttttcagatccagcgccgagatataaccccatgctggctgtttacatggcagaccaaatggtgagaggaacgggttgagcgtgacaccatacggtacaccgtactgtggctgaatgccggattccgtacccgtgcctttggcatctttcggctgctccatcgggttgccaggaccacgcgggatcagtttcgaaacaaacggcagtgccattgggttggcaatcgccacttcacgatttggatcaacggaaatcccgccccattcgaacatccccaggttacccgggaagaccagcgtaccctgttcagatggcggggtgaaaatgccttcatagcgcatctggtggaacatcacgcggcacaccagttggtcaaacatggtggctccccacatatccgcaccgctcaaatctttcgtcggacggaagctcagttcagaaaacggttgagttggggttacgtaatcgcctttcgctgcaccttggggaaccggtttttccggtgccggaaccaccagttcgccattacgacgatcgagcacaaaaatgttgccggttttcgccggagcgtaaataactggcactttctgaccattaacggtgatgtccgccagcgtcggctgtgccggaagatccatgtcccacaggtcgtggtgaacggtctggtagctccacgccagtttcccggtagtggcattcagcgccagaatcgagctggcataacgttcctgttccggtgtgcggttaccgccccagatatccggcgtggtcacgcccatcggcagatagaccagatccagcttcgcgtcataggccgctggtgcccaggagtttggcgagttaaaggtaaaggtgtgttcgtcagacgggattgcgttcggatctttcgcgccgggatcaaaagcccacagcagctccccggtgttgacatcaaaaccacggatcacgccagacgtttcgcgggttgagaagttatcggtaactgaaccggccatcacgatggttttatcggtgataatcggtggcgaagtcggttcatacagacccggtttggtgtctggcatattgctttgcagattgagcacgcctttattggcgaaggtttcgcacagtttgccgttttcagcgttaatcgcaatcagtcgaccatcattgaccggaagaatgatacgacgcgggcaatccgccatcacttccggcgaagcggtttctgctttggcttcatgataagagacaccacggcaggttacgtgctggaaagactcgttggttttcagctcaggatcgtaatgccatttctctttgccgctggcggcatcaagcgcaaacaggcgctggtgagcggtacacaggtaaagggtgtcgcccactttaatcggcgtcacttcattggtgatttcacccggatcgttcggctgcttcacatcgccagtacggaacacccaggcttctttcagattatggacgttatcggcgttaatttgtttcagcggcgaaaagcgttgaccttcctgattacgaccataggcaggccagtcctgatcggctacgggggagatagcttcagcaggtgtggcatcggcgcttaaggtgccgttgatctcctgcggatcgttaaatccggcccaggtcaggataccaccgctaatcagcagtgcgaccaccagtgcggcaactgcgccgctggcaggaatgaccaggcgacgccagacaaacggcaggatcagccagatgccgaagaagaccagaatgtcgctgcgcggagtcagcgcccagaagtcgaaaccaacttcccagacgccccaaatcatggtgccgagcagcagggctgcgtatagccaaagcgcggcgcgtttactgcgccacagcatccaggcgacgccgagcatcacaaggccagcgatagggtagtaccaggagccgccaatcgcgaccagccagcctccgccaatgagtagatacagcccgcaaagcgctgcaaaaagggctgttagcgtgacgagtaatcgtcgcgagcctgtattgttaattgccataaagagacaccatttcaattcattaatattttagtagcaattaattataggttttaacatgtgtgatcgtcatcacaattcgagctttattaacagattccgcgaatgaatagttttactggtatactgcgtgtcttgcgctttgttgcggtgccaaaacctgcccgtgcgaagtgatttgtttttaaatcatatggttagagatatgaaacatactgtagaagtaatgatccccgaagcggagattaaagcgcgtatcgccgaactgggtcgtcagattactgagcgttacaaagacagcggcagcgatatggtgctggtgggtctgctgcgtggctcatttatgtttatggcggacctgtgccgtgaagttcaggtatctcatgaagtcgactttatgaccgcctccagctacggtagcggcatgtccaccacccgtgatgtgaaaatcctcaaagatctggatgaagatatccgtggcaaggacgtgctgattgttgaagatatcatcgactcggggaatacactgtcgaaagtgcgtgagatcttaagcctgcgcgaaccgaagtcgctggcgatttgtacgctgctggataaaccgtcccgtcgtgaagtgaacgtcccggtagaatttatcggtttctcgatcccggatgagtttgtggtgggttacggcattgattacgcacagcgttaccgtcatctgccgtatatcggcaaagtgattctgctggacgagtaagtgtgaagttgccggatgtgttgcatccggcatggcatttttatttgtggttggcgtgtttcagcttgaggttggaaatcccgtgacggtaacgttgctcaagggtttcgcggttggtggcggtaacatccagatcacgcagcaagccgtcgtgaatgccgtaggcccagccgtgaatggtaactttctgcccgcgtttccacgctgattgcataatggtggagtggcccaggttatacacctgttccatgacgttcagttcacacaaggtatccagacggcgctcttgcggcatttcgccgagcaatgagctatgtttgaaccagatatcgcggatatgcagcagccagttgttgataagccccagttccgggttttcaactgcggcttgtacgccgccgcaaccgtagtggccacagataataatgtgttcaacttcgagtacatccactgcatactgaaccacggaaaggcagttcaggtcagtgtgaatgaccaggttagcaacattacggtgaacaaagagttcgcccggctcaagaccggttaaacgttctgcaggaacgcgactgtcggaacatccaatccatagaaagcgcggtttttgcgcttgtgccagtttctcaaaaaacccgggatcctcttccaccagcatttttgaccatagtgcattgttgctgatgagtgtatctatgtctttcatggaggttaacgacctgtaaccaaataattacgtttggctaatatagggcaactccgggacgatttaaaccacagataaagtgtaagaacgtaaggtaagtaaaaatttatgaccattgcactggaacttcaacagcttaaaaaaacctatccaggcggcgttcaggcgcttcgtgggatagatttgcaggtcgaagcgggtgatttttatgcgcttctcgggccgaacggggccgggaaatcgaccactatcggtattatcagctctctggtaaataaaacctccgggcgggtcagcgtatttggttacgatctcgagaaggatgtcgtgaacgctaaacgtcagttgggactggtgccgcaggaatttaacttcaacccgtttgaaaccgtgcagcaaattgtggtgaatcaggcagggtactacggcgtggagcgcaaagaagcgtacatccgcagcgaaaagtatcttaaacaactcgatctatggggaaaacgcaacgaacgtgcgcgtatgttatctggcgggatgaagcgccgtttaatgattgcccgtgcgttaatgcatgaacctaaactactgattctcgacgaaccgaccgcaggcgtggatattgaacttcgccgctcaatgtggggctttttgaaggatttaaacgacaaaggcaccaccatcattctcaccacacactacctggaagaagcagaaatgctgtgccgcaatatcggcattattcaacacggtgagctggtggaaaatacctcgatgaaggcgctgctggcgaagctgaaatcggaaacctttattctcgatctcgcaccgaaaagcccgttaccgaagctcgatggctatcagtatcgactggtcgataccgcgacgctggaagttgaagtgctgcgtgagcaggggatcaacagcgtatttacgcagttaagtgagcagggcattcaggtattaagtatgcgtaacaaagctaaccgtctggaagagctgtttgtttcactggttaatgaaaaacaaggagatcgcgcatgatgcatctttactgggtggcgctaaaaagcatctgggcgaaagagatccatcgctttatgcgtatctgggtgcagacgctggtgccgccagtcatcaccatgaccctttactttattatcttcggtaacctgattggttcgcgtattggcgatatgcatggcttcagctatatgcagttcatcgtaccggggctgatcatgatgtcggtgatcaccaatgcctacgccaacgttgcgtcatcattttttggtgccaagttccagcgtaatattgaagagctgctggtagcgccggttccgactcacgtcattattgccggatatgtcggcggtggcgtggcgcgtggtctgtttgttggcattctggtgacggcaatttcactgttttttgtgccatttcaggtgcattcgtgggtattcgttgccttaacgctggtgctcacggcggtgttgttctcccttgcgggtttgctgaacggtgtgtttgccaaaacgttcgatgacatcagcctggtgccaacctttgtgttaacgccactcacgtatttgggcggggtcttttactcactgactttgttgccgccgttctggcaagggctgtcgcacctgaacccaatcgtttatatgatcagtggtttccgctacggcttcctcggtatcaatgatgttccgctggtcactacctttggcgtactggtggtctttattgtggcgttttatttgatctgttggtcgctgatccaacgtggacgtggtttgcgtagctaaggctatttcctctcctctggatttgggggagaggagttttgacggctatcaccctttatcaacaatggtcagggtagactgattttcggctaaggaggaaggcgatgttaggttgggtaattacctgtcacgatgaccgggcgcaagagatactggatgcgctggagaaaaaacatggggcacttcttcagtgccgggccgtgaatttctggcgcggattaagctctaatatgctcagccgcatgatgtgcgatgctctgcatgaagcggactctggtgagggtgtcatcttcttaaccgatatagccggagcgccaccgtatcgcgtggcttcattattaagccacaaacactcccgttgcgaagtgatttctggtgtcacgttaccgttaattgaacagatgatggcttgccgtgaaaccatgaccagttcagagtttcgcgagcgtattgtcgaactgggtgcgccggaggtgagtagtctttggcaccaacaacaaaaaaatccgcctttcgtcctcaaacataatttgtatgagtattaacccgcgattctgatggcgcttttgctacaataaaagcgttgtttcaccctcggttattttttcatgtacaaacaagctgttattctcctgctgatgctgtttaccgcaagtgtcagtgccgcgttacctgcccgttatatgcaaaccatcgaaaatgctgcggtctgggcgcaaattggtgacaagatggtgaccgtggggaatattcgggccggacaaatcattgccgtggagcccactgccgcaagttattacgcatttaattttggctttggcaaaggttttatcgataaaggtcatctcgagccggttcaggggcgacaaaaagttgaagacggtttgggcgacctcaacaagccgctgagtaatcagaacttagttacctggaaagatacgccggtctataacgcgccgagtgcgggaagtgcgccatttggggtactggcggacaatttgcgctacccgattttgcataaactgaaagacaggttaaatcaaacctggtatcagatccgtattggcgatcgactggcctatatcagcgcactggatgcccaacccgataatggcctgtcggtgctaacctatcaccatattctgcgcgacgaagaaaacacccgttttcgccatacttcgacgaccacatcggtacgcgctttcaataaccagatggcctggctgcgtgacaggggatacgcgacactgagcatggtgcagctggaaggctacgtgaagaataagatcaatctccctgcgcgagcggtggtgattacctttgatgatggcctcaagtcggtgagccgctatgcgtatcctgtgttgaaacaatatggcatgaaggcgacggcgtttattgttacctcacgcatcaaacgtcacccgcagaagtggaacccaaaatcgctgcaatttatgagcgtttctgagcttaacgaaattcgcgatgtatttgatttccagtcacatacccattttttgcatcgggtagatggttatcgccgacccatattactgagccgtagtgagcacaatattctgtttgattttgcacgttcacgccgcgctctggcgcaatttaatccgcatgtctggtatctttcgtatccgtttggcggatttaatgacaacgccgtgaaggcagcaaacgatgccggatttcacctggcggtgacaaccatgaaaggcaaagtaaaaccgggggataatccgttgttactaaaacgactttatatcttaagaacggattcgctggagacgatgtcgcggctggtgagtaaccagccgcagggataacaatcaagcaacctgtaccggaatcgctttcgcggtacgtttcatttcattgtcgccttcaaaataggcgacgttgggtcgccaggtgcgagcttcttcatctggcatggtaacgaagctggcgatgatgacaatatcgccgacactggcgcagtgggccgccgcaccgttaacagaaataattctcgaaccgcgttctgccgcgatggcataagtggagaaacgcttgccgttggtgacattccagatatcaatggcttcgttttcgagaataccggctgcgtcaagaaaatcctggtcaatggcgcaagaaccttcatagtgcaggtccgcatgagtcactttcacgcggtggagtttgccctgcagcatcgtgcgaatcataacttctacctttctaccctgtcgttaacgaagcaggcgatgcctgctttgaggaaattctcacgcagtattgcccgatttttgtttagtgtctactcatctgacggcatttgcgtcagcagtttgcgtaccgcgccgaagcgtgccatgtatcgcctgtaacgaattgatatttctctgaacgctgctcggtaaacaataaagaggtggctgacgatagcgcgccttgactggatactgccttcacgcaaagccacacggaagacagggaagatggatgcaccgagtaccacaccgcatgacgcggtatttaaacaatttttaatgcatgcggagacggctcgcgactttctggagatacatttgccagtggaattacgcgaactttgtgacctcaacacgcttcatttagagtcggggagtttcattgaagagagcctgaaaggacacagcacggacgtgctctattccgtgcaaatgcagggcaatcccggttatctgcatgttgtgattgaacaccaaagcaagccggataagaaaatggcctttcgcatgatgcgttattctatagccgccatgcaccggcatctggaggctgaccacgataagctgccgctggtggtgccgatactgttttatcagggcgaggccacaccttatccgctatcaatgtgctggtttgatatgttttactcgccggagctggcgcgacgcgtctataacagtcctttcccgctggtggatatcaccatcacaccggatgacgaaatcatgcaacatcggcggattgcgattctcgaactactgcaaaaacatattcgccagcgcgacttaatgttattgcttgagcaactggtcacgctgatcgacgaagggtacactagcggaagtcagttagttgccatgcaaaactatatgctgcaacgcggtcatactgaacaagcggatttgttttacggtgtgttgagagacagggaaacgggaggggagtctatgatgacgctggcgcagtggtttgaagagaaagggattgagaaggggattcagcagggaagacaggaagtaagtcaggaattcgcccagcgtcttctgagtaaaggaatgtctcgggaagacgttgcagagatggcaaatttacctcttgctgagattgataaggtaattaaccttatttaagttacctgtgttatgacagatgacgtggggtaaattaataactggcgccatcagccgtagcgccagttaagtattacgccagctcgaccattttgttgtcgatcaggcgagcatcgccaagccaggcggctaccagaattactgcccgtttgctggtttcagaaacttccagcaatgtgtcggcatcgcgaatctgaatatcatcggcgcggaagcctttttcattcagttcttgccccgcaatggtaataatttcatcgagatcccgttccccagcctgcaatttgtcagcaatcgaacttaaaactttgtacagaccaggcgcaattttgcgttgttccgccgtcagataaccgttacgggaacttagcgccagaccgtctttggcgcgcataattggcacaccgacaatctcaatatcgaagcccatatcggcaaccattttgcggatcagcgccagttgctgaaaatctttttcaccgaagcaggcgatgtccggctggaccaggttgaacagcttgctgacaatagtcgaaacgccgcgaaaatgtcccggacggctggcaccttccagcatggtcgaaaggccaggaacgtcaacgtaagtgtgggtttcagtaccgttcgggtagatctcttttaccgaaggggcgaaaactaaatccactttacgtttgtttagcttctcgcagtcctcctgcaaggtccgtggataacgagccagatcttccgggcggtcgaactgcatcgggttaacgaaaatactgacgacgaccacatcggcgcgggctttggcttcgtcgaccagcttcatatggccatcgtgcaggttacccatggtaggcaccagcgccacgcgcttgccttccatacgcaggcggcgaatttgctgacgcagcagcggcagggtttcgataattaacacaacgtgactccttaatggaaactgtgttcttcgcccggataaacgccggactccacttcagccatatactgccgcacagccgcgcggatgtcgcccgtttcggcgaggaaatttttagcgaatttaggaatgtgaccgccggtaataccaaaggcgtcgtgcatcacgaggatctgcccgtcagtgacgttgcctgcgccaatgccaataaccgggatcgccagtgcttcggtaatacgttttgccagttcaaccggcacgcattccagcaccagcagctgtgccccagcagcttctaaggctaatgcatcgctgagcagttgatcgcccgcttcatcgccgcgcccctgaactttgtagccaccgaaaatattcactgactgtggtgttaaacctaagtgaccacatacaggaacggcacgttcggtcagcatttgtacggtttctaccagccactcaccgccttcaattttgaccatgttagcaccggcacgcataaccgttgcggcgttttcgaaggcttgttccggcgtggcatacgccataaacggcaggtcagccagcagcaggcagtttggtgcgccgcgacgtacggcggcagtgtggtaggcgatatcggcaacggtaactggcagggtggagtcgtgcccctgaaccgtcatgcccagcgaatcgcccaccagcatgacgttaagcccttcatcagcaaagagtttggcgaagctatagtcataagcggtgatggtcgcgaaacgttttttttcctgtttgtacttctgcagtaaggagatggtggtcggtttcataacgtatcctgataaattgatgttgtgctgtctggcattttatcagtcacattggtgggggcaatgatttatccgtagcagcactgccagaaggtgacagtgctgctacgttatcagggataggttacctggaaagtactggtggctttaaattcgccgggttcgatagcaatattcccgtcttgctttaatgttgcctggaaatgaagaggctgtgatgtgccgttaccttgattagggtaaaccccatcggaggtgtcatcttcggtttcataatctatataaacagaattcgtatcattaggttttaatgtcattagcggatttttactggttgctaaaccttcaatgagtacgccaacgcctttggcggcagtgcttccagtaagcgtattaccaagcagttgtgtgttttgagtacctacttttccagtgacgagttttgtttcaatattacgcacacgaatacaattctgaagcgagatatcaaagggaacaggtgaagcgccatttttaattgtcccagagctatattctcccattctaaccgttgaaccattgactgatggcccggtaagtatggaggtaaaacatgttggtaaggttaatttgacattattcagtgtgaaattgacataaatgtggttgctgtgatctacaacttttgtaccaggactgtaggccttaaacgaataaaggtaatttgatgaactggataactggacttgctgattaagtgtaggatcgaaattagtatctgtataaaattcaacagttatgttgtgtactataccaccaatagcccaaaacttatcgtagtcgtctgctttgttgcaacccttagtttgtagatcgctgtctgtgacggaaaagaaaaattcttggttggaaggatctccgatatagattcctggcgattgaatgtcagttattgtatcgtatgcagaccagacccttgatattaacatggtgtaatacagaccaggaacagatgtattaaatagtttatgtccgccataatctttacctgaatagaccatggcattttcaatagttattggaccaggattcgctctgccagatgtattgcagtaaagaataccaccaccggtacctgtatccaggtatgaccagtacatttttaccccagtcgggccgagctgcgtgggtttataaaaaaccaagttgcttgctgttgatgtgtaattaaaggtcatctgtgcggcagtggaggggcctcgatagttatcaactcctgcattatttcccacaataaaacttgtatatgcactgactgtattacaacaagaatacagtgctaaaaaaagaatgtacctgaagatagtcttcatttttactccaatgtttctttattgttatggtttgcgctgtttttgtttgttattcgtagtaaatatccactaacacatggctcataagttgaccagatgtaacactcaatgcaggatcgattttttgcattcgggtgctaaatttccaggatgaaccattcatgtcatccgacattactggataaacggaacgagatccgcctgaagcattaagaacattgaatgtattcgccgaatcctgagtagaaaatataactactcctacattacttgctcctgacgaaatttcattagcaaatatttgcctagagccagcagccatgacaccgctaagggctctaaaatcaatatgtaactgatttagcacatcgccagttccctgtaatgcacagtcggatacagtgatagtgaactcttttccacctggttgataactttcaggagtaacattacctgaaaaatatcccaccccaacgacgccaagatcaatattaccctggttactgattccgcttttgcaggtgctgttttttacattggcaacaaggtcaatatcctgtccagcaatggctggacaggcgatgcaaaacagtaatgacagaaacagaattattctcttcatcagcttacgttgagtgggatgcatatatagttcctgaatctgtaagtctgttagttataggttactgtaaatgtggctggtgcagaaaacttacccgcagtgacattgtttacggttttatttttttccacgaccaggcgtgcactcatcggataataaacgaccgcattggctgcagtggagattgttacctcttgtgatgctggtgttacacagctaaattgtgttgcactccctgttgccggagttacagtgctccagacttcaacggcgacagcacttgctttatctgcggctgtggaaccatttgcaaaccccgcaccgtcattagcagttccctcgcatgtggctcgcttggttaattttatttgcgcttttttattggggatacccgcacagtctttgaatttgagtttgaatgtttttactttggtcttggcattgatttcagaaatatatacatcaccaaaatcaacaacagaaatgtcctgatcagagtcatttactaatgtagcggtacaagtacccatttctacagtagtaataacggtcagtccaatactgtctgttgccgcataagagagtacgctgaacaatgaggcagccaaaacgacactgctggataatccataacgtaaatttttaaatgtcatcataattatccttcttattgatagatgaaattaaacgtcgccagtgcacgaaaattccccggtacgccttgccctgcatctgtttcacgtagcgcaacggtcatttcaagacccttatcgggctgcatctcgtctgtgctccagcgtatcttttccgcactgttaggtttaaggaaagtggcatcatcagtagtccgttttttgaaacccataccgatattacttgtcgtcgaagatgaatcaccagactgcggtataataagcttaggtgagcttgatgatgcatttccggtcagagtggtatcaatccaactgatgccactgctgcacccactggcaaccagtttaaaatcagcctgagattctgtcgttttattcgcgatcttatccagacccatcttagggattctcaatgtgtagttattattgccatcattcgtgacgttattaccagtaagtgtgatgttacaggttgtcgctttgacagtggctgtaaactctacattaatatccgttgcaaatactgagggtgataataatattcccatcagtatcactattttatgtggcgttgtttttatcatttgacgtcccttgtagttactgaatctgacaccgaattccattcagaataatagattgtgctattttttctgcttctgggctttgttgataatgcgcaagacaacttacgggtttactttgttcgagccatttaatgctgatatttccctgctgctcaataccacgaacaaatgcttgtccaccctgtccaacattaccaatgacattgccttgctcatcataaatatctgcagcaaatggaatatttttaccatcacttcgtgtgatgttcataatggctgattgcccttgcacggtttcaaaatcagcaaagacgactgaaccctgacgcggtacagctactgcactggtactttttaattcaacatcgttctcaagatcgttgatatccagcgcgatacggttttcatgataaggagaaagagcgctggtgacaccataaccccatcgatcgatagtactgttgccataatttattcgcgctccttgagcacctggagcctgaactaccgccagtgtatcggagtcgctaaaactatcattactgaaagtcagtccaccgctatgcaatacaaaaccaccgtcggtgctgagagaaacttgacggctgttatcgctatttgcagaaattgaacctgccagcgttccccatggtgactcatagctggcataacccccaacataactcaaatctttgctggctttattcatcgtatagccagtattcacgctataactgacgcgagcgttatcgctatagccactgctgctaacgttgagttggttattacccttaaagtcactgcttatttgagtatcaatactctggaaacctgaagtacgttgttcagtgccaagtaatttttcaattggaatggtgaaactaagataaacgctatcgtcagtgtcgccgtcttcattccatgaacgctgggcactgacactgtagctgccccaggatgtactgttactgtagccaatagagtaattgctacgattttgtccggaagcccagtaatcggaccaacttccggaaagataaaatgaaccgtaatcttttttctcaaatttcaacggttggttaatactgaccgtaacctgatttttcatgcgtgagtaattacgcatggatttcggttcaagatcttgttcgggatgtttcacttcatcaattagagttagtgcatcattaagaccaaggtaattctgtgtcgaatagcgataggccgcgatattcagtgaagtacttgtttcttcgaataacttgttccaggaaacacgataactttgcccctggtatgttttatcatccgggatacgaacattggaatgagtcacatcgaaagaaaatgcaccaactgaagtattcagaccaagacctaacaaaccagcggtatagttattatcggttatctgaataccggtataacccgtcagatagttattcaggccgtagtagtagcttgcttgaaataaattaggctcatcctgaatatcatcttttaagacctgaccgccgctaatatcccaacgtccaacgccagggcgtaacatttgaacaacggatgagaaaggttgcgagaatgtccgctttgagccatcggattcttcgatggtaacaataagatcgctgccgtaccctgacggactcagatcatcaatgacgaaagcgcctggcggcaccgtcgtttcataaatcttatagccaccttgcgtaatagtgactttggcgttggtattggcaacgccatgaatgataggcgcaaagctggctaaagtcggaggcaacatgcggctgtcactgtataaacgaatgcctcggatactgacggaatcaaaggtttcgcccgtcgtataagactcaccaagaatgagttgagaacgcagcgaggcgatatcacgctgaacataccgattcttaaaatcataattactgccagaatcggtcatccagttgtagttgcccgaggcacgcagtcgccatgcacctaaattcatcccaccgttaaatgcagcataaatgctttcattttttcgaccaggggtttcactatgatatccgttgaggttgtatgacaacatggccgcattaatgccgttttcccataacgatggatcaacatagttttggtaatttttcattacccaggcttgaggaacgtctatatccagacgttgatcgttaacgtcataacgaacagaagcctgagggataatttccgtcaaattgaggcaattgccgagcgtttcatccctggcaagcagaacggctttttcgttatttatatcgggagaattaatatgaaactgcaataaattctttaatgtgatacaagcctgggcgttcttttttccttcaattgcgacaaatgtaatactttggttaatgattggttggtcgtttacataaacactgacgtcgtaaacacccggtatagcggggttaccttcactgtaccggctgagatcaatattagatgcattctgccccatcaggaaggtatggtcatattcaacgagttcagcactgaaagcagtattgcaatacagcagcgcgcaaaacgtggcgatacgggtcagatgatgataatttttagtatattctatagtcacgctatgcttcctgcggaattatatccttgcctgattacagcctggcattaccttcaattgcgccaccaaagtcattaatggcgtaaaaatgcacttttgcagaattcgctttgccattaaggccattgactttcatgacctcatcactaaatggtgcaatcattttcacatcaatcggatagcgtttaccgctagcttctaaatcaccactgctaaaagagacgtagtaaggggttggattggtcactcgtaatgacgccttaccttctgaacctgaccagaaccacttcagggctaacggggcttcagagggatttcccttcaatccatccgggcgatagaaaagttttatacgtgtgcgaaatgccagttgcagcaggctttgattcgcgaccttttctgcatctggttttggtggaacttccagtacgttaaaccagaacacgctctctctgtctttaggcagtgaggtgctggctgtgtacattaatttgattgtttgcccacgtttggcatcaatacgcgatactggcggcgtagcagtaaaagggactgtaatactgccaggctcagcgttgtcatcgccagtatctaaccaactctggacaagcaacgggttattccctttattttccagacgtacgttgacacttttttgatcgcttttatatattacgcgagtacccgaaatgacaatgtccgcaatagacgatgaactaaaagccatacaggttacgaagcataaagctgttgtatgtttggtgttaaaaaacataaaccatccctgatagagttaattaaaacagggaataatataaaatagaaattattattccctgtatattcattcaatcaatttaactggtgaatacttactgataagtaatggtgtatgcagtgttagtttttacataaccagcagttgctgtttggtctgcgacggcacgaacgtaagacgctttaaaatcataaacagcagattttgtcgttgcatccagggctttagtatacacatcgccagggttgttaatttgaacctgtttgatagtggaaccatcaatattgtgtagagcgatattaacgccgtcagatgggttgttaatagacatgtcgttgttcaaagtccctttgctgttaccaaagaaaacagaaccgaaggtcattttagccgtgctacctggattcggatttgctttgctgcagtcaacggtgatgctgaaaggtttagctttagcgccaacggtgtcattcagtacgccagcatcgatttcaccaacggttgcggtttgcagcaggatcagaccatccttgttaccgccgtcaacgcgggtttcacaggtgttatcaacaaccagaccactgatatttaactgaccgccgtccatatcagcagaagcagtacctgcaaccatcgccagcataagaccagacagggcaaaacctaattttttagacataaaaatcctttaataaaattccattagtcagactacatgtttgaagaatgactattcatgacacaaataggagaaacaaatgttagatattaatgagcaatgatatttgttacccaaatttacaaccattgttcattaggtcgcctattgtgcactttagaagcttttgaacaaattaaatttacttaattcaaaattaagtaaaaataagttcacaagtgcaattggttagggtatggagatgggattgatatttatttataggaagttatattatttccgcaaagagatgtttaaactaaaatcgtaattaaggaaagagatgagatatgattttcagaaaatatttatattcgcaatataaataaattaccatttgtttaatttgtcaaatgctcttgtatgtaagatttgacgcaacatctccccatcaggaaacaccaactccggcgcgatttcaaacagcggccacagcataaatccacgattcttcatatcgtagtgcggaacggtcaggcgttcagtatttatcacttcattaccaaacagcatgatgtcgagatccagcgtgcgtggtccccagcgttcagctttgcggacgcgaccttgctgcaattcaatacgctgtgtgtgattgagtagctcttcaggtgcaagagaggtttccagcgccacggctgcgtttaagtaatcgggttgatcttgcggccccagcggtggggtgcggtaaaacgaagaaacggtaagaatgtggctttcagggatatcgcctaatgctttcagggcagcattgacctgctccagcggagaggccagattgctgcctatggcaatatacgccactgtcatgcggtaccctcacgacgtggtgcgcgtttgcgtggacgacgagtacgacgacgcggtgacggttcttcatccagctcgttgagcatccctttttggtctggtggcgcggaaacctggaactcaccccaccatttcaccagacgctgcagttcagcgttacgctcaacttcagctcgcaaggccaacaggtcataagccgcacggaacttaggatgctccagcagtttccatgcgcgtttaccctgacgacgggacatacgcaactgcaactgccagatatcgcgggttaatgtcgtcagacgtttcgggattgccagtgaacggcaggcttcgtccagcacgtcgttcatcgccagcgcgaaagcgtcgtgataggtcaggccgctttcctgggcgatcttctgtgccgtctccagcagtgggtaccagaacatggcggcaaacaggaacgccgggttcacgcgcatatcgttatggatacgcgtatcggtattcttcagcacctgttcaatgatccgctccatcgggctgtcgccattttccgtgaagtagcgggtaatggtcgggaacagcggctggaacagatgatattcacacaacagcttataggtttcgtaaccgtagcccgcttgtagcagtttaagcgattcttcaaacaggcgtgccggtgggatatcgttcagcagggtagcgaggcgagggatcggttctgcggtttccgggctgatgcgcatacccaatttggcggcaaaacgtaccgcgcgcagcatacgtaccggatcttcacggtagcgcgtttccgggttaccaatcagacggataacgccgtccttcagatccttcatgccgccaacgtaatcacggacggtaaaatccgctacgctgtaatacaggctgttgatagtgaaatcgcggcgctgggcgtcttcttcgatggagccgaaaatgttgtcgcgcagcaacatgccgttttgcccgcgttgggaggtcgtgcggtcgctgacgttaccttcgtggtgtccacggaaggtcgcaacttcgataatctccgggccaaacattacatgagccagacggaaacggcgacccaccaggcggcagttacggaacagtttgcgcacctgctcaggcgtggcgttagtggttacgtcaaaatctttcggctttttgccaagtaacaggtcgcgcacgccgccgccaaccagccaggcttcgtatcccgctttattgagcctgtacattaccttcagggcattttcactgatatctttgcgggaaatagcatgctgctcacgcgggatcaccgtcacctgtggacgggcgactgcctgttcagcctcgctttcctcgcggcttagcaccttgcggcaaaaattagcgactcgggtaaaaatagtacacctcggtagtgtcaaacatcattcaggacaaaaaaatagcggctaatcatagctcagcatgacgcatttgagaatgttgaatttacaattgccgactcgggcacggcggtaagccgccagtttttgacggctgactgaaggatttgctcgacgctgaaatcctgccagtgtgcttctgcctgctgccccagaaattgaagtgccgcgattagtaccgggcgtggatcgcctttcggcaacgcaggcgcatgattctgcttggaaagtttagcgccttgtggattaagcgccagcggcagatgaatgtaatctggcactttccagccaaaaagctggtacagcgagatttgccttactgttggttcaatcagatcagccccacgcactatttctgtaacgccctggaaatgatcatcaaccacaacagccaggttgtaggcgaacaacccatcacggcgatgaatgataaaatcttcccgtgccagtttttcgtcggcgtgaataatgccgcgcagctggtcagtaaattgcgtgaccggatgctgctggcggatacgcactgcggcgttgtctggtccatgatgcaacacccggcaatgaccgtcgtaaataccgccaatgctttgaatacgcgcacgcgtacaggtgcagtaataacttagtccttgttcatgtaaccaggcgagtgcttcacgataggcgtcgtgacgttgcgattgccagagaacatcgccgtcccagtgcagaccgtaatgttccagctggcgcaggatagtttctgcggcaccgggaacttcacgaggcgggtcgatatcttctatgcgtaccagccagcgaccttgccgggcgcgagcctgcaaatagctgccgagcgcggcgatcagagagccaaaatgaagctcgccggaaggagagggggcgaagcggccaatatactgtgtgtctgtcatctctttgaacaaaaaataaggcgggagcatttcccgcctgtggtaaacgtgatggaacggctgtaattagccagccatctgtttttcgcgaatttcagccagcgttttgcagtcgatgcacagatcggctgtcgggcgcgcttccagacggcgaataccaatttcaacaccgcaggattcgcagtagccgaaatcttcgtcttccacttttttcagcgtcttctcgatctttttgatcagcttacgctcgcgatcgcggttacgcagttcgaggctgaactcttcttcctgggctgcacggtctaccgggtccgggaagttggctgcttcatcctgcatatgtgtaacggtgcgatcgacttcatccctgagttgattacgccatgcttccagaatacgacggaagtgcgccagctgggcttcattcatatactcttcgcccggcttctcctgatatggttccaccccagcgatggcgagaatactcagggacgatgttttacggttttgcccttcttgcatgttgcttctccttaacacgcactatcgatccccatgttcgggggaaaaatgaggccgctataaatagcagatgcttttccggatagcaattatctaaacgtaacacttgacaactgtgtgaggaaaagcgtatttgcgcacgcgaccagaatgtaaattaaccagttacttactttactacaatgtaaccggcagtgattttttaagagccatgccttcagcagaaatttccgctttgtaagccagaatttctacccccctctgttgagcttctgacaatagttgcgcgtatttctcatcgatgtggcgcgcgggtgaaaaccgtgtaatggctgaatgcagcacggcgaaaaagataaccgcacgctggccttcagccgctacgctcatcaactcccgaaggtgtttctgacctcgttcagtgaccgcatcgggaaaatatccctgttcgttctccgctaacgtaaccgatttcacttcaatatagcagtctggacgcgaatccgcctgcaacataaagtcaatacggctgcgttctgcgccgtattttacttcgcttttcagcgagctatagcctgacagttctgaaattgattcattaaggatagcctctttcgtcaacctgttagcccaaagcgtgttgacgcaaataaatgcgccgctctggctttgagttaattcccaggtgtgtgggtatttccgtttggtgttgtctgaagtcgaataccagacggtatcgccaggcgttgcacaaccggtcatcgcacccgtattcgggcagtgtagcgttaattcgcgaccatcgggtgtgatcacatcggctaaaaaacgtttgtaacgctgaattagcgtcgcgcgctgtagagggggagaaaattccattgcgacaatccttgttattgcgttagcgcccagcgttttagcggcgtgtagcgtgtgcgtccacgggcaaacgaggaggcgtaaagggtgaactccgtcaccgcatacgaccagttaaaacctggcggcgggattgtcaccgcctcgctggcgtcgcgcaataaggtaatatgtggatgaaacggacgattgctttgaaaacaaccgctgcgggcagcctgtgaacggagcatattcgccagctggattaagccgcgtggcggctgacgcatccctaaccacaccacacgcgaacgcagccattgtccggcgtcatcaagcgtgagtgtgaaaccaggttgacgaatccgtccggctaaaagagaaagcgccttctctttctcggcgctcacttcgcctaaaaatgccagagtcagatgcaaattatcggcggcgaccggacgtcccgcctcaggtgggaagtgtgtggcgcgccaatggataatctgttcgcggatttctgcaggtaagtcgatagcaaagaacagacgttgcggttcagacatgtgaggcactcggttatgaattaccgcgatgctacaatgtggcgcgaagaatgttaaccctctggagcgttttgtgtcgtcgttgcccgttgctgccgtcttacctgaattacttaccgctctcgattgtgcgccgcaggtattattaagtgcgccgaccggggccgggaaatcaacctggctgccgctgcaactgctggcgcatcccggcattaacgggaaaattatcctgctggagccgcgtcgtctggcggcgcgtaacgtcgcgcaacggctggcggagctgcttaacgaaaagccaggcgataccgttggctaccggatgcgtgcgcaaaactgcgtcgggccgaatacccgcctggaagtggttaccgaaggcgtgctgacgcgcatgatccagcgtgacccggaactgagcggtgttggactggtgatccttgatgaatttcatgagcgcagcttgcaggcggatttggcgttggcgctgttactcgatgtgcaacaaggtctgcgtgatgaccttaaactgctgattatgtcggctaccctggacaacgaccgcttgcagcaaatgctgccagaagcgcctgtcgtcatctcagaagggcgctcgtttccggttgaacgccgttatttaccgctgcccgcgcatcagcgttttgacgatgccgttgcggtagccaccgctgaaatgctgcgtcaggaaagcggatcattactgttatttttacctggcgtcggagaaattcagcgtgtgcaggaacaactggcttcgcgcatcggcagtgatgtattgctctgcccgctgtatggcgcgttgtcgctgaacgatcagcgaaaagcgatcctcccggcaccgcaagggatgcgcaaagtggtgctggcgaccaatattgctgaaaccagtttaaccattgaaggtattcgtctggtggtggattgtgcccaggagcgtgtggcgcgttttgatccgcgcacggggcttacgcgactgattactcaacgcgttagccaggcatccatgacgcagcgtgccgggcgcgccgggcgtctggagccgggtatcagcctgcatttaatcgccaaagaacaagcagaacgcgccgcggcgcaaagtgaaccggagatcttacaaagcgatctttccggtttgctgatggaattactgcaatggggatgcagcgatccggcgcagatgagctggctggatcaaccgccagtagtgaatctactggccgcgaaacgtctgttacaaatgctgggggcactggagggtgaacggcttagtgcgcaagggcaaaaaatggcagcgctgggtaacgatccgcgtttagcggcaatgctggttagcgcgaagaacgacgacgaagctgctaccgcggcaaaaattgccgccattctcgaagagccgccacggatgggcaatagtgacctgggcgtggcgttttcgcgcaatcaaccagcctggcagcaacgtagtcagcaactgttaaaacgcttaaacgtacgtggcggtgaggcagacagttcgcttatcgcgccgctacttgccggggcgtttgccgatcgcattgctcgtcgccgtgggcaagatggacgctatcaactggcaaacggcatgggagcgatgctcgatgccaacgacgcgctaagccgccacgaatggttgatcgcaccgttattattgcagggcagcgcctcgccggatgcgcggattttactggcgctgctggtcgatattgatgagttagtacaacgctgcccgcagctggtacagcagtctgacactgtggagtgggatgacgcgcaaggtacgctgaaagcctggcgtcggctacaaatcggtcagttgacggtgaaagtgcagccgctggcgaaaccgtcagaagacgagttgcatcaggcgatgcttaatggcatccgtgataaaggtttaagcgtgctcaactggacggcggaagcggaacagctacgcttgcgtttgttatgcgccgcaaagtggttgccggaatatgactggccagcggttgatgatgaaagtttattggcagcgctggaaacgtggctgctgccacatatgactggcgtacattcactacgcggcctgaaatcactcgacatttatcaggcactacgcggattacttgattggggaatgcagcaacgtctggatagtgaattgcctgcgcattacactgtgccgacgggaagccggatcgccattcgttatcatgaagataacccgcccgcgctggcggtgagaatgcaagagatgtttggcgaggccaccaatccgacgatcgcccaggggcgcgtgccgctggtgctggagttgctttcacctgcccaaaggccattacaaatcacacgagatttgagcgacttctggaaaggagcgtaccgtgaggtgcaaaaagagatgaaagggcgttatcccaaacatgtctggccggacgacccggcaaatactgcaccgacgcgacggacgaaaaagtattcgtaaggttggttttctccctctccctgtgggagagggccggggtgagggcatcagcgcgcacgttcaccctcaccctaaccctctccctcaagggagaggggaccgatcgagcacaaattttgagagatatcttcttctgtcttgtaacagaagaacagaaaatcgggcttttgcgcctgaatattgcggagaaaaagcatggccgggaatgaccgcgagccaattggacgcaaagggaaaccgacgcgtccggtcaaacaaaaggtaagccgtcgtcgttacgaagatgacgatgattacgacgattatgatgactatgaggatgaagaaccgatgccgcgcaaaggtaagggcaaaggcaaagggcgtaagcctcgtggcaaacgcggctggctatggctactgctaaaactggctatcgtttttgccgtgctgatcgccatttacggcgtttatctcgatcaaaaaattcgtagccgtattgatggcaaggtctggcaactgcctgcggcagtttatggccgaatggtcaatcttgagccagacatgaccatcagcaagaacgagatggtgaagctgctggaggcgacccagtatcgtcaggtgtcgaaaatgacccgtcctggcgaatttaccgtgcaggccaacagcattgagatgattcgccgtccgtttgatttcccggacagtaaagaaggacaggtgcgcgcgcgtctgacctttgatggcgatcatctggcgacgatcgtcaatatggagaacaaccgtcagttcggtttcttccgtcttgatccgcgtctgatcaccatgatctcttcgccaaacggtgagcagcgtctgtttgtgccgcgcagtggtttcccggatttgctggtggatactttgctggcgacagaagaccgtcatttttacgagcatgatggaatcagtctctactcaatcggacgtgcggtgctggcaaacctgaccgccggacgcacggtacagggtgcgagtacgctgacgcaacagctggtgaaaaacctgttcctctccagcgagcgttcttactggcgtaaagcgaacgaagcttacatggcgctgatcatggacgcgcgttacagcaaagaccgtattcttgagctgtatatgaacgaggtgtatctcggtcagagcggcgacaacgaaatccgcggcttcccgctggcaagcttgtattactttggtcgcccggtagaagagctaagcctcgaccagcaggcgctgttagtcggtatggtgaaaggggcgtccatctacaacccgtggcgtaacccaaaactggcgctggagcgacgtaatctggtgctgcgtctgctgcaacagcaacagattattgatcaagaactctatgacatgttgagtgcccgtccgctgggggttcagccgcgcggtggggtgatctctcctcagccagcctttatgcaactggtgcgtcaggagctgcaggcaaaactgggcgataaggtaaaagatctctccggcgtgaagatcttcactacctttgactcggtggcccaggacgcggcagaaaaagccgccgtggaaggcattccggcactgaagaaacagcgtaagttgagcgatcttgaaactgcgattgtggtcgtcgaccgctttagtggtgaagttcgtgcgatggtcggaggttctgagccgcagtttgcgggctacaaccgtgcgatgcaggcgcgtcgttcgattggttcccttgcaaaaccagcgacttatctgacggccttaagccagccgaaaatctatcgtctgaatacgtggattgcggatgcgccaattgcgctgcgtcagccgaatggccaggtctggtcaccgcagaatgatgaccgtcgttatagcgaaagcggcagagtgatgctggtggatgcgttgacccgttcgatgaacgtgccgacggtaaatctggggatggcgctggggctgcctgcggttacggagacctggattaaactgggcgtaccgaaagatcagttgcatccggttccggcaatgctgctgggggcgttgaacttaacgccaatcgaagtggcgcaggcattccagaccatcgccagcggtggtaaccgtgcaccgctttctgcgctgcgttcggtaatcgcggaagatggcaaagtgctgtatcagagcttcccgcaggcggaacgcgctgttccggcgcaggcggcgtatctgacactatggaccatgcagcaggtggtacaacgcggtacgggtcgtcagcttggggcgaaatacccgaacctgcatctggcagggaaaacagggactaccaacaataacgtagatacctggtttgcgggcattgacggcagcacggtgaccatcacctgggtcggccgtgataacaaccagccgaccaaactgtatggtgccagcggggcaatgtcgatttatcagcgttatctggctaaccagacgccaacgccgctgaatcttgttccgccagaagatattgcagatatgggcgtggactacgacggcaactttgtttgcagcggtggcatgcgtatcttgccggtctggaccagcgatccgcaatcgctgtgccagcagagcgagatgcagcagcagccgtcaggcaatccgtttgatcagtcttctcagccgcagcaacagccgcaacagcaacctgctcagcaagagcagaaagacagcgacggtgtagccggttggatcaaggatatgtttggtagtaattaacatctaagcgtgaaataccggatggcgagttgccatccggtaaaataacatcccatctaagatattaaccctttcttttcatctggttgtttattaacccttcaggaacgctcagattgcgtaccgcttgcgaacccgccagcgtttcgaatattatcttatctttataataatcattctcgtttacgttatcattcactttacatcagagatataccaatggcgcgttccaaaactgctcagccaaaacactcactgcgtaaaatcgcagttgtagtagccacagcggttagcggcatgtctgtttatgcacaggcagcggttgaaccgaaagaagacactatcaccgttaccgctgcacctgcgccgcaagaaagcgcatgggggcctgctgcaactattgcggcgcgacagtctgctaccggcactaaaaccgatacgccgattcaaaaagtgccacagtctatttctgttgtgaccgccgaagagatggcgctgcatcagccgaagtcggtaaaagaagcgcttagctacacgccgggtgtctctgttggtacgcgtggcgcatccaacacctatgaccacctgatcattcgcggctttgcggcagaaggccaaagccagaataactatctgaatggcctgaagttgcagggcaacttctataacgatgcggtcattgacccgtatatgctggaacgcgctgaaattatgcgtggcccggtttccgtgctttacggtaaaagcagtcctggcggcctgttgaatatggtcagcaagcgtccgaccaccgaaccgctgaaagaagttcagtttaaagccggtactgacagcctgttccagactggttttgactttagcgattcgttggatgatgacggtgtttactcttatcgcctgaccggtcttgcgcgttctgccaatgcccagcagaaagggtcagaagagcagcgttatgctattgcaccggcgttcacctggcgtccggatgataaaaccaattttaccttcctttcttacttccagaacgagccggaaaccggttattacggctggttgccgaaagagggaaccgttgagccgctgccgaacggtaagcgtctgccgacagactttaatgaaggggcgaagaacaacacctattctcgtaatgagaagatggtcggctacagcttcgatcacgaatttaacgacacctttactgtgcgtcagaacctgcgctttgctgaaaacaaaacctcgcaaaacagcgtttatggttacggcgtctgctccgatccggcgaatgcttacagcaaacagtgtgcggcattagcgccagcggataaaggccattatctggcacgtaaatacgtcgttgatgatgagaagctgcaaaacttctccgttgatacccagttgcagagcaagtttgccactggcgatatcgaccacaccctgctgaccggtgtcgactttatgcgtatgcgtaatgacatcaacgcctggtttggttacgacgactctgtgccactgctcaatctgtacaatccggtgaataccgatttcgacttcaatgccaaagatccggcaaactccggcccttaccgcattctgaataaacagaaacaaacgggcgtttatgttcaggatcaggcgcagtgggataaagtgctggtcaccctaggcggtcgttatgactgggcagatcaagaatctcttaaccgcgttgccgggacgaccgataaacgtgatgacaaacagtttacctggcgtggtggtgttaactacctgtttgataatggtgtaacaccttacttcagctatagcgaatcgtttgaaccttcttcgcaagttgggaaggatggtaatattttcgcaccgtctaaaggtaagcagtatgaagtcggcgtgaaatatgtaccggaagatcgtccgattgtagttactggtgccgtgtataatctcactaaaaccaacaacctgatggcggaccctgagggttccttcttctcggttgaaggtggcgagatccgcgcacgtggcgtagaaatcgaagcgaaagcggcgctgtcggcgagtgttaacgtagtcggttcttatacttacaccgatgcggaatacaccaccgatactacctataaaggcaatacgcctgcacaggtgccaaaacacatggcttcgttgtgggctgactacaccttctttgacggtccgctttcaggtctgacgctgggcaccggtggtcgttatactggctccagttatggtgatccggctaactcctttaaagtgggaagttatacggtcgtggatgcgttagtacgttatgatctggcgcgagtcggcatggctggctccaacgtggcgctgcatgttaacaacctgttcgatcgtgaatacgtcgccagctgctttaacacttatggctgcttctggggcgcagaacgtcaggtcgttgcaaccgcaaccttccgtttctaatttctcttttggggcacggatttccgtgcccatttcacaagttggctgttatgcaggaatacacgaatcattccgataccacttttgcactgcgtaatatctcctttcgtgtgcccgggcgcacgcttttgcatccgctgtcgttaacctttcctgccgggaaagtgaccggtctgattggtcacaacggttctggtaaatccactctgctcaaaatgcttggccgtcatcagccgccgtcggaaggggagattcttcttgatgcccaaccgctggaaagctggagcagcaaagcgtttgcccgcaaagtggcttatttgccgcagcagcttcctccggcagaagggatgaccgtgcgtgaactggtggcgattggtcgttacccgtggcatggcgcgctggggcgctttggggcggcagatcgcgaaaaagtcgaggaagctatctcgctggttggcttaaaaccgctggcgcatcggctggtcgatagtctctctggcggcgaacgtcagcgggcgtggatcgccatgctggtggcgcaggatagccgttgtctgttgctcgacgaaccgacctcggcgctggatatcgcccaccaggttgatgtgctgtcgctggtgcaccgtttaagtcaggagcgtggcctgacggtcattgccgtgttgcacgatatcaatatggcggcacgctactgtgattatctggtcgccctgcgcggcggtgaaatgattgctcagggaacgcctgcggaaattatgcgcggcgaaaccctcgaaatgatttatggcatcccgatgggtattttgccgcatccggcgggtgctgcacctgtgagttttgtttattgatgagcggcttacctcttatttcgcgccgtcgactgttaacggcgatggcgctttctccgttgttatggcagatgaataccgcccacgcggcggctattgatcccaatcgtattgtggcgctggagtggttgccggtggaattactgctggcgctcggcatcgtgccttacggcgtggcggataccatcaactatcgcctgtgggtcagcgaaccaccattgccggactcagtgatcgacgtcggtttgcgcacagaacctaaccttgaactgctgaccgaaatgaaaccatcgtttatggtctggtcggcaggatatggcccttcaccagaaatgctggctcgtattgcgccgggtcgcggatttaacttcagtgacggcaaacagccgttggcgatggcgcgtaaatcgctgacggaaatggcagatttacttaacctgcaaagcgcagcggaaacgcatttagcgcaatatgaagactttatccgcagcatgaaaccccgctttgtgaagcgtggtgcgcgtccgttattgctgacgacgcttatcgatccgcgccatatgctggtcttcggtccaaacagcttgttccaggaaattcttgatgagtacggcatcccaaatgcctggcaaggggaaaccaacttctggggcagtaccgccgtcagtatcgatcgtctggcggcgtataaagacgttgatgtgctctgttttgatcacgacaacagcaaagacatggatgcgctaatggcaacgccgctgtggcaggccatgccgtttgtccgcgccggacgctttcagcgcgtacctgcagtctggttttatggtgcgacgctctcggcaatgcactttgtgcgcgttctggataacgccatcggaggtaaagcgtgagtaaacgaattgcgcttttcccggcgttattgctggcgctgttagtgattgtcgctacggcgctcacctggatgaacttctcgcaggcgctgccgcgtagccagtgggcgcaggctgcctggtcgccggatattgacgtcatcgagcagatgatttttcactacagcttgttgccgcgtctggcgatttcgctgctggtgggcgcgggtctggggctggtgggcgtgctgtttcagcaagtgctgcgtaacccgctggcggagccgacgacgcttggcgttgctacaggcgcgcaactggggattaccgtcactacgctctgggcgatccctggtgcgatggcgagccagtttgctgcgcaggcaggggcttgtgttgttggcttaattgtctttggcgtcgcgtgggggaaacggctgtcgccggtaacgctgattctcgcggggttggtagtgagcctttattgcggcgcaatcaatcagttactggttatcttccatcatgaccaactgcaaagcatgtttctgtggagcactggaacgctgacgcaaaccgactggggcggcgttgagcgtttatggccgcagctgctgggcggtgtgatgctgacgttgctgctacttcgtccgttaaccctgatggggcttgatgatggcgtggcgcgcaatctcgggctggccttgtcgcttgcgcgtctggcagcgctgtcgctggcgattgtcatcagtgcgctgctggtgaacgctgtggggattatcggctttatcgggttgttcgcgccgctgctggcaaaaatgctgggggcgcggcgtctgctgccacgactgatgctggcgtcgttgattggtgcgctgatcctctggctttccgatcaaatcatcctctggctgactcgcgtgtggatggaagtgtccaccggttcggtcactgcgttgatcggtgcgccgctgctactgtggctgttgccgcgtttacgcagcattagcgcgccggatatgaaggtcaacgatcgtgtcgcggctgaacgccaacatgtgctggcgtttgccctcgcgggcggcgtgctgctgttgatggctgtggtggtggcgctgtcgtttggtcgtgatgcgcacggctggacgtgggcgagcggggcgttgctcgaggatttaatgccctggcgctggccgcgaattatggcggcgctgtttgcgggcgtcatgctggcggtggcgggctgtattattcagcgactgaccggaaacccgatggcaagcccggaagtgctggggattagctccggcgcggcgtttggcgtggtgttgatgctgtttctggtgccgggtaatgcctttggctggctgttacctgcaggcagtctcggcgcggcggtgacgctgttgatcattatgatcgccgccggccgcggtggattttccccacaccgtatgttactggcggggatggcgttaagcaccgcgttcaccatgcttttgatgatgttgcaggcaagtggtgacccgcgaatggcgcaagtgctgacctggatttccggttcgacctacaacgcgaccgatgcgcaggtctggcgcaccggaattgtgatggtgattttgctggcgattaccccgctgtgccgccgctggctgaccattttaccgctgggtggtgataccgcccgagccgtaggaatggcgctgacgccgacgcgaattgcgctgctgctgttagcggcttgcctgacggcgaccgcgacgatgactattggaccgttgagttttgttggtttaatggcaccgcatattgcgcggatgatgggctttcgacggacgatgccacacatcgtaatttcggcgctggtgggtggtttactgctggtgttcgctgactggtgtgggcggatggtgctgtttccattccagatcccggcggggctgctgtcaacctttatcggcgcgccatattttatctatttgttgagaaagcagagccgttaatttttccatataacggccctgtacgcctggacggataaagcgtttacgcgacaacggatgcccgatgcgacgctggcgcgtcttatcgggcctacaaacggccccgaatcgtaggtcggataaggcgttcacgccgcatccgacaaaccatgctggatcacaacttcgcaaacacccgacgtgcagcatcgatggtgttattgatatcttccatgctgtgcgccacggacataaagcccgcttcaaacgctgacggtgccaggtaaacaccttcgtccagcatcatatggaagaaacgcttaaagcgttccacgtcacaggccatcacatcctgatagcacgtcacggactcggcgtcggtaaagaaaataccgaacatgccgccaacgtggttaacgaccagcggaattccggcttcttctgccgcttccagcagaccttctgccagacgtgttgtcagctcatccagcgtttcgtgaacgcccggctgcgcgacttcattcagacaggcgaaacccgctgccatcgcaatcgggttaccggaaagcgtacccgcctgatagaccggacccgtcggggccagcgcatccattacatcacgacgaccaccgaatgcgcctaccggcattccaccgccgatgattttgccgaggcaggttaaatctggcactacgccgtaataatcctgtgcgccagctagcgctacgcggaaaccggtcatcacttcatcgatgatcagcaacgcgccaaattcgtcgcacagcgcgcgcagacctggcaggaactctggcagcggcggaacacagttcatattgcctgccaccggctcgacgataatacaggcaatctcttgcgggtattgctcaaatgcggcgcgtacagaagccagatcattataagtacaggttaaggtatatttggcgaaatctgccggaacgcccggcgagtttggctggcctaacgtgagtgcgccagaaccggctttcaccagcaggcagtcagcgtgaccatggtaacacccttcaaatttaataattttgtcgcgaccggtaaaaccacgggccaggcggatggcgctcatggtcgcttcagtgccggagttcaccatgcgcaccatatccatggtcgggaccagttcggtcaccagttgcgccattttcacttccatttcggttggtgcaccaaagcttaaaccacgctcggcggcttcaatcacggcattgcggattgccggatggttatggcccagcaccatcggcccccaggaaccgacataatcgatataggctttgccatcaacatcgtacagataagcgccgtccgctttttcgataaacagtggagtgccgcccacgccagtaaaggcgcgaacaggggagttcacaccgccagggatcagctcgcgcgctgcgctgtaaagattttcagacttactcatggagggttcctgattcgtagaaaaagtgaatggctgctattctatgttattcataacaagttaaatactcgtcaaacatcaggctgcttgtactggtgcaatcctgatttcttagagtataaaagttttgtgcatttgaaacattacgctttgcaaaggattttcatggaacgtgcgagtaaaatgccgtcatcttatttgtatgaccaataagtgatcattggatgaaaactgatactccctctttagaaacaccgcaggccgcgcgcctgcgacgcagacaactgattcgccaacttcttgagcgcgataaaaccccgttagccattttgtttatggcggcagtcgtcggcacgcttgttgggctggcagcggttgcttttgacaaaggtgtcgcctggttgcagaaccaacgtatgggggcgctggtacatactgctgataattatccgcttctgttaaccgtcgcttttctctgttcggcggtgctggcgatgtttggctactttttggtgcgcaaatacgcgccggaagcaggtggttcggggatcccggaaattgaaggggcgctggaagatcaacgtcccgttcgctggtggcgtgtattgccggtgaagttctttggcgggctggggacactcggcggaggcatggtgttggggcgcgaagggccaaccgtgcagatcggcggtaacattggccgtatggtgcttgatattttccgcctgaaaggtgacgaagctcgccatacgctgctggcaaccggtgctgctgcggggctggctgcggcctttaacgcgccgctggcgggtattttgtttattatcgaagagatgcgtccgcagtttcgctatacgttaatttcgattaaagcggtatttattggtgtcattatgtcgaccattatgtaccggatttttaatcatgaagttgcgttgattgacgtcggtaaactttctgatgcgccgcttaatacgctgtggctttatctgatcctcggtattatttttggcattttcggccctatttttaataaatgggtgctggggatgcaggatttgctgcaccgtgtgcacggcggcaatattaccaaatgggtgctaatgggcggtgcgattggcggtctgtgtggattgctggggtttgtggcaccagcaacgtcgggcggcggttttaacctgattcctatcgctaccgcggggaatttcagcatgggaatgctggtgtttatcttcgtcgcgcgggtcattaccaccttactctgcttctcttccggcgcgccgggcggtatttttgccccgatgctggcgctgggtactgtgctgggaaccgctttcggaatggttgccgttgagctgtttccgcaatatcaccttgaggcggggacgtttgctattgccggaatgggggcattactggcggcatctattcgcgcgccgttaacggggatcattctggttctggagatgaccgataactaccagctcattttgccaatgattattaccggtcttggcgcaacactattagcgcaatttaccggcgggaaaccgctatactcggcgattcttgcgcgcacgctggcaaaacaggaagctgagcaactggcgcgaagcaaggccgcatcagccagcgagaatacttgaacgaaataccagggtattagataatggcgattattattgggttagaatttgcccaattgccgatgtcgtttggagcaaaatatgagtgatgacgtagcactgccgctggagtttaccgacgcagcagccaacaaagttaaaagcctgatcgctgacgaagataacccgaatctgaaattacgcgtgtatatcaccggtggcggttgcagcggcttccagtatggtttcacctttgatgatcaggtgaacgaaggcgatatgaccatcgaaaaacagggcgttggcctggtggttgatccgatgagcctgcaatatctggtcggcggttccgttgattataccgaaggtctggaaggttctcgtttcatcgtgaccaacccgaacgcgaaaagcacctgcggttgcggttcttcctttagtatctaatctgttgttcatgtgccggataaactatccggcacatcttctctcttcaacgcccattctcatccagcgcaaacgtcggtagcttaagatgccaacgaatagccgccagccgaatcaatagcgtcacgaccatgcccatcatactggctgtttccagtggtacggaaaatgtgtaataagccgtagcgtggacaataccgccgataatacaggcagttgcgtagatttctgtacgtaaaatcatggggatttcgcgggccagaacatcacgaatgatcccgccgccaacgccagtaatgacgcccatacaaaccgcgattaacggaccggcttccgcattaaaggctttattcacgccaatgccgacaaacaccgccagaccaacggcgtccagcaccggcaacatccattttggtaagcgtcttggctggcgcaccagcacgatggtcagcatgctggtgaccattgcaacgaccagatcggtgggatctttcacccaaaataccgggccgtgatccagcgccatgtcgcgaattgtcccgccgcctactgcggttaccacgcccagtaccagaacaccaaaagggtccatacgcaattttccggctaacaaaacgccggagatggcaaataccgctgtgccgactatatccagccaatagacgagcattgttcaatccccactgagcacctgaaaaggtcaggcgctaatctacctgtgaaagcgcattacagagctgttgtgcagcgaggataatacgtgggcttgcacgttcaaaccagtcactcgtgagaggaataacgggaattttgagctgttcaccccagtattgtttgattttaggaatttggtccggtccgcctgtaatgacaatcgcctgtggcgagcgtgctaacacctgttcgcggctaacttgcggccagggaacccggctgtctttaaagatgttttctccgccacaaacttcgagtacctggttctgaatcgactcttttccactggtaaatggcggattaatgccgaattgcagaaaaacacgttttttaggtttatcagcatattgcgctttcaattgcgcgtactgatccagcagggattgcgcggcttgttcggccttgtctggttgcggactccagggggccagttgacgtaacgcattggcaatttgttcaatgcttgtcgcatcgacccacatcacttttattcccagcgaagccagctggtcaacctgccgctcggcattacctccacgccaggcaatcaccagatcgggtttcagcgcgacaatgcgttccagattcatcccctgccaggtggaaacctgctcaatcttttgcgcttgtggaggatagtcggaatagctgctgaccccaaccggcgtgatcccggcggcaaaggcaagttcagtgttggcgggagaaagcgtgatgacgcgcggcgcggcgttgagccacagtggcgcaagaaaagacagggcgaccagcgccctgaacagtgacttagccatgtgcaagtttctgcaccagtgactcaaccatcaggctggactgtttagcggcaacagccaggaactcatcgaagctaagatgagactgttgatcggccacgtcggagatggcgcgtacgacaacaaacgggacgttgaaattgtggcagacatgggcgattgccgtcgcttccatctctacagcaatggcctgtgggaagttgtggcggattttcgccagaccaacagaaccgttgatgaaagcgtcgccgctaacaatcaggccacgtacagcgttaagattcagttcggcaatgcaggcctcagcggcagcgatcagtttatcgtcagctttaaagcctgccggacagcctggtaactgaccgtattcataaccaaatgccgtgacatccgcgtcgtgataacgtgcttcgtccgagacaacgatatcgcccactttcaacgttggtgccaggccaccggcagaaccggtgttaataatcacatctggcttgcagtgttccaacagcaaagtggcacccagcgccgcagcgactttaccgatgcccgatttcagaagcgcaacctcggttccattcagttggccggtatagatttcgcaaccgccgagactgatagtttgacggttttcgattttgtcacgcagcagcgtaacttcttcttccattgcaccaatgatgccgattttcatagatttactcgcgataagcccgatttgaaggcatagtttaccatgcgcttacggggaagcgtatttctcacgcgggagaggacatggcacagattgatttccgaaaaaaaataaactggcatcgtcgttaccgttcaccgcagggcgttaaaaccgaacatgagatcctgcggatcttcgagagcgatcgcgggcgtatcatcaactctccggcaattcgtcgtctgcaacaaaagacccaggtttttccactggagcgcaatgccgccgtgcgcacgcgtcttacccactcgatggaagtccagcaggtggggcgctacatcgccaaagaaattttaagccgtctgaaagagcttaaattactggaagcatacggcctggatgaactgaccggtccctttgaaagcattgttgagatgtcatgcctgatgcacgatatcggcaatccgccgtttggtcattttggcgaagcggcgataaatgactggtttcgccaacgtttgcacccggaagatgccgaaagccagcctctgactgacgatcgctgcagcgtggcggcactacgtttacgggacggggaagaaccgcttaacgagctgcggcgcaagattcgtcaggacttatgtcattttgaggggaatgcacaaggcattcgcctggtgcatacattgatgcggatgaatctcacctgggcacaggttggcggtattttaaaatatacccgtccggcgtggtggcgtggcgaaacgcctgagacacatcactatttaatgaaaaagccgggttattatctttctgaagaagcctatattgcccggttgcgtaaagaacttaatttggcgctttacagtcgttttccattaacgtggattatggaagctgccgacgacatctcctattgtgtggcagaccttgaagatgcggtagagaaaagaatatttaccgttgagcagctttatcatcatttgcacgaagcgtggggccagcatgagaaaggttcgctcttttcgctggtggttgaaaatgcctgggaaaaatcacgctcaaatagtttaagccgcagtacggaagatcagttttttatgtatttacgggtaaacaccctaaataaactggtaccctacgcggcacaacgatttattgataatctgcctgcgattttcgccggaacgtttaatcatgcattattggaagatgccagcgaatgcagcgatcttcttaagctatataaaaatgtcgctgtaaaacatgtgtttagccatccagatgtcgagcggcttgaattgcagggctatcgggtcattagcggattattagagatttatcgtcctttattaagcctgtcgttatcagactttactgaactggtagaaaaagaacgggtgaaacgtttccctattgaatcgcgcttattccacaaactctcgacgcgccatcggctggcctatgtcgaggctgtcagtaaattaccgtcagattctcctgagtttccgctatgggaatattattaccgttgccgcctgctgcaggattatatcagcggtatgaccgacctctatgcgtgggatgaataccgacgtctgatggccgtagaacaataaccaggcttttgtaaagacgaacaataaatttttaccttttgcagaaactttagttcggaacttcaggctataaaacgaatctgaagaacacagcaattttgcgttatctgttaatcgagactgaaatacatgaaaaaaaccacattagcactgagtgcactggctctgagtttaggtttggcgttatctccgctctctgcaacggcggctgagacttcttcagcaacgacagcccagcagatgccaagccttgcaccgatgctcgaaaaggtgatgccttcagtggtcagcattaacgtagaaggtagcacaaccgttaatacgccgcgtatgccgcgtaatttccagcagttcttcggtgatgattctccgttctgccaggaaggttctccgttccagagctctccgttctgccagggtggccagggcggtaatggtggcggccagcaacagaaattcatggcgctgggttccggcgtcatcattgatgccgataaaggctatgtcgtcaccaacaaccacgttgttgataacgcgacggtcattaaagttcaactgagcgatggccgtaagttcgacgcgaagatggttggcaaagatccgcgctctgatatcgcgctgatccaaatccagaacccgaaaaacctgaccgcaattaagatggcggattctgatgcactgcgcgtgggtgattacaccgtagcgattggtaacccgtttggtctgggcgagacggtaacttccgggattgtctctgcgctggggcgtagcggcctgaatgccgaaaactacgaaaacttcatccagaccgatgcagcgatcaaccgtggtaactccggtggtgcgctggttaacctgaacggcgaactgatcggtatcaacaccgcgatcctcgcaccggacggcggcaacatcggtatcggttttgctatcccgagtaacatggtgaaaaacctgacctcgcagatggtggaatacggccaggtgaaacgcggtgagctgggtattatggggactgagctgaactccgaactggcgaaagcgatgaaagttgacgcccagcgcggtgctttcgtaagccaggttctgcctaattcctccgctgcaaaagcgggcattaaagcgggtgatgtgatcacctcactgaacggtaagccgatcagcagctttgccgcactgcgtgctcaggtgggtactatgccggtaggcagcaaactgaccctgggcttactgcgcgacggtaagcaggttaacgtgaacctggaactgcagcagagcagccagaatcaggttgattccagctccatcttcaacggcattgaaggcgctgagatgagcaacaaaggcaaagatcagggcgtggtagtgaacaacgtgaaaacgggcactccggctgcgcagatcggcctgaagaaaggtgatgtgattattggcgcgaaccagcaggcagtgaaaaacatcgctgaactgcgtaaagttctcgacagcaaaccgtctgtgctggcactcaacattcagcgcggcgacagcaccatctacctgttaatgcagtaatctccctcaaccccttcctgaaaacgggaaggggttctccttacaatctgtgaacttcaccacaactccatacatcttcatcatcctttaggcatttgcacaatgccgtacgttacgtacttccttatgctaagccgtgcataacggaggacttatggctggctggcatcttgataccaaaatggcgcaggatatcgtggcacgtaccatgcgcatcatcgataccaatatcaacgtaatggatgcccgtgggcgaattatcggcagcggcgatcgtgagcgtattggtgaattgcacgaaggtgcattgctggtactttcacagggacgagtcgtcgatatcgatgacgcggtagcacgtcatctgcacggtgtgcggcaggggattaatctaccgttacggctggaaggtgaaattgtcggcgtaattggcctgacaggtgaaccagagaatctgcgtaaatatggcgaactggtctgcatgacggctgaaatgatgctggaacagtcgcggttgatgcacttgttggcgcaggatagccgtttgcgggaagaactggtgatgaacctgattcaggcagaggagaatactcccgcacttactgaatgggcgcaacggctggggatcgatctcaatcaaccgcgagtggtggctattgttgaggtcgacagcggtcagcttggcgtggacagcgcaatggcggagttacaacaactgcaaaacgcgctgactacgcccgagcgtaataatctggtggcgattgtctcgctaaccgaaatggtggtgttgaaaccggcgttgaactcttttgggcgctgggatgcagaagatcatcgtaagcgagttgaacaactgattacccgcatgaaagagtacggccagctgcgttttcgcgtttcactgggcaactattttaccggtcctggcagtattgcccgatcctatcgtacggcgaaaacgacgatggtggtgggtaaacagcggatgccagaaagtcgctgctatttttatcaggatctgatgttacctgtgttactcgacagtttgcgtggcgactggcaggccaacgaactggcgcgaccgctggcgcggctgaaaacgatggacaataacggcttgctgcgacgaacgctggcggcgtggtttcgccacaatgtgcaaccgctggcaacgtcaaaggcgttgtttattcatcgtaataccctggagtatcggcttaatcgtatatcggaactgaccgggcttgatttgggcaattttgatgacaggttgctgctgtatgtggcgttacaactggatgaagagcggtaggttatgcgttaaggttgaggcggcgctggctcattcccctcagcccgaagggtagaggggaatgcccgaattaaccgtcagttcgggattatttacgcgttagtttttccagatcggcttcaatctcgctgatcttattggttacgactgactccaggtgacgtaagtcgtcgaggatcttacgcttaagatcaacttcgctgcggtcacgctggcagatttgatcaagctcatcaatgatataccgtagattcgggctgatttcctggacttctttataaccctgacccacaccatcagcgacgaccgttttacgctgacgcggatatttaaacttaacgctcttggcgaaaaactcgcctttgtctttctggaaatagattttcagaatatcgttgttggcttcctgccggaggctgtaacgatcaatttcttcaggattggtaatacccagacttttcagattgtcgtacatagcgttacctcaaaatgagtcagtaaattgtgcttattttagcatttggcctggcccgcccggctcgactgtgatcgcagaaagcctttttcttccagacttctatcatggcgtaaaaatcaaaaaattacctgctttattctggtgataaaattcacgatctacaccagttccagcatcgttacttccgggcggcagttcagacgcaaaccatacaaactgcccacgccacgggttgtgtagatgtgtctttcgccaaaggcatttaatccggcgacgtaacgtttatcttcgacaggggcaaaaggttcaccaaccaacggtacgcgcagttgcccgccgtgagtatggccgcacagcatcagatcccagggttcatcacgcatgacttctttgctgtcgggattatgcgccagcaccagtcttggcagattggcttcgctggcgggaggcggtttgcattgtccggcccataagtcaccagtgcctaccagttcgaattgcctgttcggcgtggcgatcaccgtagcctggttaaacaacaccgtgatgcccgctgatttcaacgtctcgccaattaagtgatttttttctgtaccaacagggcgatcgtggttgccgaagcaggcaaacgtcggcgcacattcggcaaggggggagagtacgtcactaaacgccgaaaaattcagcgacatatcaaataatacgtaatcgccgcccagtaatatcaaatcgggcttttgttctatgccaagagcaatcgcgtcagaaatcaggcttaaaggaacaaaacgagagtaatggagatcggccagaaaaagaattttgaatggtgctgcgttgtctttaaaaaaggcgaggcggtgacggattaattcaaaccagcctggctcacagtaatgcatataaccgaaacctgagctcgtggctatcgtcgcggcagtagcctgcaaaaatcggcggcgtgaaatcatcgctcatccctgcaaaaaaatcgggcagcgtcgtgctgcccgtgtgcatacttttagtcgatggtacgcagcagttcgttaatgccgactttgccgcgagttttcgcgtcaactttcttaacgataaccgcacagtagaggctgtatttgccatcttttgacggcagattacctgaaacaaccacagaccccgccggaacgcgaccgtagtggatttcgccggtttcacggtcgtaaatacgggtgctctgaccaatgtatacgcccatggaaatgacggaaccttcttcgacaatcaccccttcaaccacttcagagcgcgcgccgatgaagcaattatcttcaatgatggttgggttagcctgcagcggttccagcacgccgccgatgcccacgccaccggaaaggtggacgtttttaccaatctgcgcacaagaaccgacggtcgcccaggtatcaaccatggtgccttcatcaacatatgcgccgatgttgacgtaagacggcatcagcacggtgttacgggcaataaacgcaccctgacgtaccgccgctggtggcacaacgcggaagccttctttctggaaacgtgcttcgtcgtagtcggcgaatttcatcggcactttgtcgaagtagcggctttctgccccttcgatcacctgattatcattaatacggaaagagagcagcaccgcttttttcaaccactgatgcgtcacccactgaccgtcaattttttccgctacacgcagtgcgccggaatccagcagggcgatcacctgatttaccgcttcgcgggtaacggtgtctgcattggctggcgtgatctcggcacggcgttcaaaagcggtttcaataatgttctgtaactgctgcattgttaaactcttttcatatcagtaaacacatcaccctttatcgtttggattgagggcctctgtcaaccgctgatgcacttcctgctgcaactcgttattaagcgcacgccggtcagcggtggcaattatgaataaatcttctactcgctcgccaatggttgtaattcgggcaccatgaagcgaaattcccagatcggcaaaaattttcccgactcgcgccagcagtccaggttggtcgagggcgatcagttcgaggaacgatttgcggtcggtatgggtcggcaaaaacgttacttcggtttcaacagtaaaatggcgtaatttggcgggttggcgacggggctgcggtggctgccagctactttgcgtcagtacttgctccagaccaaaccgaataacctcatgacgatctgcggacagcgggttgccatcgggttccagcacgataaaggtatccatcgccataccgtcgcgagtggtgaaaatttgtgcgtcgtgaacacttaaattgcggcggtctaattcggcacagacggcggcaaacagataagggcggtccgggctccagataaaaatctcggtgcctccacgcgtagcctgcgggctaagcaataccagcggtttgcttaaatcatgctgtaataaatggcgggcatgccaggccagttgatttgggctatggcggacaaaatagttagcacgacagcgtgaccaaatttggtgcagcgcctcttcgtcgatgttatccatgcgcagtagtgccagtgcctggagttggtgatggcgaacccgttcgcgcatatccggcgtgttttgcattccgcgtcgtagctgcttttcggtggcaaagtagagctcacgcaacagactttgcttccagctattccacagcgtttcgttggtggcgcaaatgtcagccacagtcaggcataccagatagcgcagacgattttccgtttgcacttcttcggcaaactgcttgatgacttccgggtcctgaatatcgcggcgttgggcggtcaccgacatcaacaggtgctggcgaaccagccaggcgaccagctgtgtttcgcgtgagttcagcccgtggagttcggcaaaatgcactacatcctgagcaccgagaatggagtggtcgccgccgcgtcctttggcgatatcgtgaaacagcgcggcgatgaaaatcagctcagttgacggcaggcgcggccagacgtccacacacaacggatggcgctggcgcgtttcttcactggcaaaactctccagtttcagcatcacgcggatagtatgttcatccaccgtgtaggcgtggaacagatcaaactgcatctgcccgacgatatgcgaccattgcggcatatacgcgccgagcacgctatggcgatgcattggcaatagcccgcgccgcaccgctccggggtgacgcagaatgctcaaaaacagttttcgtgcttccggaatattacacagcggttgttgcagatggcgacgggcatggcgtaactggcgcagcgtggtggagtaaatgccggtgatcgcactgttgtgcaccatggtgtagaacatacgcaagatggcttccggctggcgcataaatagtgtttcatcacgcaggtcgattagcgtaccgcgtagctgaaactcatcgtcgattggacgtggtttttcgtcggcgggaagggcgaggatggcttcatcgaacagttgcagcagcatctggttgagttcactgacgcggcgtgtaacgcggaagtaatccttcatcatccgctcgaccggttcgttaccttcaccactgtaattcagacgctgggcgacgctaagctggcgatcgaataacaggcgattatcgtaacggctgacgaccagatgcagggcaaagcgaatacgccacaatatatgcagacattcgtttaattccgcccgctccgctgaggttaagaagccaaacccgaccatttcatccagcgatgttgcgccaaaatgacggcgggccacccattgcagagtgtggatatcgcgcaagccgccagggctgcttttgatgtctggttcaaggttgtagctggtgccatggtaacgctgatggcgctggttctgttcttcaactttcgccgcgtagaacttgtcggaaggccagaatccttcgctgaaaatatgtttttgcagttcgaggaacagcgcaacatcgccaattaataagcgggattcgattaaattggtggcgacggttaaatccgataacccttccagcatgcactcttcaagcgtgcgcacgctatgaccgacttccagctttacatcccagagcagcgttaacagctcgcccactttttgcgcctgatcgtccgggagctttttacggcttaaaatcagtaaatcgacgtctgaaagtggatgcagctcgccacgaccgtagccaccgacggcgaccaatgccaggtcggcaatctggctgaatcccgcttcaatccataatcgttgcaggagctggtcgataaactcggtgcgcgcctcaatcaactgttctgcagagatcccattgtcaaaggcatcacccagccaacgctggaaagtatcgatatgggcttttatcccaccgacggttaattcatcacggggccagacgcatggattttgcggttgaccgggcagggtggggagagcggtgtttgcgtactgttctggaagggtattcattgtgcgccacccataagattaaattatcgcattaaaaaagccggcattcgccggcttcatcttattcgtcgtgcgagattatcgccgggatggtgtcatccttgcgtagcgtcagaatttcgcagccgttatcagtcaccacaatagtatgctcatattgtgcagacaagctgcgatctttggtttttaccgtccagccatctttcatggtgcggatctcttttttacccgcgttgaccattggctcgatggtgaacgtcatcccaggtttcagtacgacgttggtttcacgggagtcatagtgcagcacctgcggttcttcatggaagccgcgaccaataccgtgtccgcaatattcacgaacgacggagaagccttctgcttcgacaaatttctgaatcgccgcaccgatttcgcgcagattaatgcctggttttaccatgcgtagcgccaggtacaggctttcttgcgtgatgcggcacagacgttcgcccatgatggtcggcttaccgacgataaacattttcgaggtatcgccgtggaaaccatctttgattacggtgacatcaatgttaacgatatcgccatctttcagcagcttagcatcgtccgggataccgtggcacaccacttcattaatagagatgcaaacggatttcggatagccgtgatagccgaggcaggcagaaaccgcgtgttgttcattaacaatgtaatcattacagatgcgatccagctcgccggtgctgacgcccggtttaacatacggttcgatcatctccagcacttcggcagccagtcggccagcgacgcgcattttttcgatatcttctggggtcttgattgagatagccattaattctgtccatcagcgtcggtgataccgacaatatatatgtaagtgccgtcaatggtatcacacccgggcaaattgagaatcattctgaatttcgccaaacgtgccactgaaggttttctataatagaaaattcgacgtctgatgctgtacacagcgccaacaattattggtgtccacgacgtatttgtggtataaagcgcgccggacttccgatccatttcgtatacacagactggacggaagcgacaatctcactttgtgtaacaacacacacgtatcggcacatattccggggtgccctttggggtcggtaatatgggatacgtggaggcataaccccaacttttatatagaggttttaatcatggcaactgtttccatgcgcgacatgctcaaggctggtgttcacttcggtcaccagacccgttactggaacccgaaaatgaagccgttcatcttcggtgcgcgtaacaaagttcacatcatcaaccttgagaaaactgtaccgatgttcaacgaagctctggctgaactgaacaagattgcttctcgcaaaggtaaaatccttttcgttggtactaaacgcgctgcaagcgaagcggtgaaagacgctgctctgagctgcgaccagttcttcgtgaaccatcgctggctgggcggtatgctgactaactggaaaaccgttcgtcagtccatcaaacgtctgaaagacctggaaactcagtctcaggacggtactttcgacaagctgaccaagaaagaagcgctgatgcgcactcgtgagctggagaaactggaaaacagcctgggcggtatcaaagacatgggcggtctgccggacgctctgtttgtaatcgatgctgaccacgaacacattgctatcaaagaagcaaacaacctgggtattccggtatttgctatcgttgataccaactctgatccggacggtgttgacttcgttatcccgggtaacgacgacgcaatccgtgctgtgaccctgtacctgggcgctgttgctgcaaccgtacgtgaaggccgttctcaggatctggcttcccaggcggaagaaagcttcgtagaagctgagtaataaggcttgataactcccccaaaatagttcgagttgcagaaaggcggcaagctcgagaattcccgggagcttacatcagtaagtgaccgggatgagcgagcgaagataacgcatctgcggcgcgaaatatgaagggggagagcccttatagaccaggtagtacacgtttggttagggggcctgcatatggccccctttttcacttttatatctgtgcggtttaatgccgggcagatcacatctccgaggattttagaatggctgaaattaccgcatccctggtaaaagagctgcgtgagcgtactggcgcaggcatgatggattgcaaaaaagcactgactgaagctaacggcgacatcgagctggcaatcgaaaacatgcgtaagtccggtgctattaaagcagcgaaaaaagcaggcaacgttgctgctgacggcgtgatcaaaaccaaaatcgacggcaactacggcatcattctggaagttaactgccagactgacttcgttgcaaaagacgctggtttccaggcgttcgcagacaaagttctggacgcagctgttgctggcaaaatcactgacgttgaagttctgaaagcacagttcgaagaagaacgtgttgcgctggtagcgaaaattggtgaaaacatcaacattcgccgcgttgctgcgctggaaggcgacgttctgggttcttatcagcacggtgcgcgtatcggcgttctggttgctgctaaaggcgctgacgaagagctggttaaacacatcgctatgcacgttgctgcaagcaagccagaattcatcaaaccggaagacgtatccgctgaagtggtagaaaaagaataccaggtacagctggatatcgcgatgcagtctggtaagccgaaagaaatcgcagagaaaatggttgaaggccgcatgaagaaattcaccggcgaagtttctctgaccggtcagccgttcgttatggaaccaagcaaaactgttggtcagctgctgaaagagcataacgctgaagtgactggcttcatccgcttcgaagtgggtgaaggcatcgagaaagttgagactgactttgcagcagaagttgctgcgatgtccaagcagtcttaattatcaaaaaggagccgcctgagggcggcttctttttgtgcccatcttgtaaattcagctaacccttgtggggctgcgctgaaaagcgacgtacaatgtcgctagtattaattcatttcaatcgttgacagtctcaggaaagaaacatggctaccaatgcaaaacccgtctataaacgcattctgcttaagttgagtggcgaagctctgcagggcactgaaggcttcggtattgatgcaagcatactggatcgtatggctcaggaaatcaaagaactggttgaactgggtattcaggttggtgtggtgattggtgggggtaacctgttccgtggcgctggtctggcgaaagcgggtatgaaccgcgttgtgggcgaccacatggggatgctggcgaccgtaatgaacggcctggcaatgcgtgatgcactgcaccgcgcctatgtgaacgctcgtctgatgtccgctattccattgaatggcgtgtgcgacagctacagctgggcagaagctatcagcctgttgcgcaacaaccgtgtggtgatcctctccgccggtacaggtaacccgttctttaccaccgactcagcagcttgcctgcgtggtatcgaaattgaagccgatgtggtgctgaaagcaaccaaagttgacggcgtgtttaccgctgatccggcgaaagatccaaccgcaaccatgtacgagcaactgacttacagcgaagtgctggaaaaagagctgaaagtcatggacctggcggccttcacgctggctcgtgaccataaattaccgattcgtgttttcaatatgaacaaaccgggtgcgctgcgccgtgtggtaatgggtgaaaaagaagggactttaatcacggaataattcccgtgatggataaataagggtaagattccgcgtaagtatcgcgggggcgtaagtctggttataaggcgttattgttgcaggcagtttggtcacggccagcgcgcagcaaccggagcgtacaaaagtacgtgaggatggcgagcactgcccggggccaaaatggcaaataaaatagcctaataatccagacgattacccgtaatatgtttaatcagggctatacttagcacacttccactgtgtgtgactgtctggtctgactgagacaagttttcaaggattcgtaacgtgattagcgatatcagaaaagatgctgaagtacgcatggacaaatgcgtagaagcgttcaaaacccaaatcagcaaaatacgcacgggtcgtgcttctcccagcctgctggatggcattgtcgtggaatattacggcacgccgacgccgctgcgtcagctggcaagcgtaacggtagaagattcccgtacactgaaaatcaacgtgtttgatcgttcaatgtctccggccgttgaaaaagcgattatggcgtccgatcttggcctgaacccgaactctgcgggtagcgacatccgtgttccgctgccgccgctgacggaagaacgtcgtaaagatctgaccaaaatcgttcgtggtgaagcagaacaagcgcgtgttgcagtacgtaacgtgcgtcgtgacgcgaacgacaaagtgaaagcactgttgaaagataaagagatcagcgaagacgacgatcgccgttctcaggacgatgtacagaaactgactgatgctgcaatcaagaaaattgaagcggcgctggcagacaaagaagcagaactgatgcagttctgatttcttgaacgacaaaaacgccgctcagtagatccttgcggatcggctggcggcgttttgctttttattctgtctcaactctggatgtttcatgaagcaactcaccattctgggctcgaccggctcgattggttgcagcacgctggacgtggtgcgccataatcccgaacacttccgcgtagttgcgctggtggcaggcaaaaatgtcactcgcatggtagaacagtgcctggaattctctccccgctatgccgtaatggacgatgaagcgagtgcgaaacttcttaaaacgatgctacagcaacagggtagccgcaccgaagtcttaagtgggcaacaagccgcttgcgatatggcagcgcttgaggatgttgatcaggtgatggcagccattgttggcgctgctgggctgttacctacgcttgctgcgatccgcgcgggtaaaaccattttgctggccaataaagaatcactggttacctgcggacgtctgtttatggacgccgtaaagcagagcaaagcgcaattgttaccggtcgatagcgaacataacgccatttttcagagtttaccgcaacctatccagcataatctgggatacgctgaccttgagcaaaatggcgtggtgtccattttacttaccgggtctggtggccctttccgtgagacgccattgcgcgatttggcaacaatgacgccggatcaagcctgccgtcatccgaactggtcgatggggcgtaaaatttctgtcgattcggctaccatgatgaacaaaggtctggaatacattgaagcgcgttggctgtttaacgccagcgccagccagatggaagtgctgattcacccgcagtcagtgattcactcaatggtgcgctatcaggacggcagtgttctggcgcagctgggggaaccggatatgcgtacgccaattgcccacaccatggcatggccgaatcgcgtgaactctggcgtgaagccgctcgatttttgcaaactaagtgcgttgacatttgccgcaccggattatgatcgttatccatgcctgaaactggcgatggaggcgttcgaacaaggccaggcagcgacgacagcattgaatgccgcaaacgaaatcaccgttgctgcttttcttgcgcaacaaatccgctttacggatatcgctgcgttgaatttatccgtactggaaaaaatggatatgcgcgaaccacaatgtgtggacgatgtgttatctgttgatgcgaacgcgcgtgaagtcgccagaaaagaggtgatgcgtctcgcaagctgaggataatccggctacagagagtcgcgctatttgttagcgtagggcttcagtgatatagtctgcgccatctgatcgtaagtagttggctttataaggtcagatatgccgtggttttacacggcttttttttgtataggcttcagtattcctgagtaccgtaaaccctgtcagggaataaaaaacgcgtgatgttgtctgctactcaaccacttagcgaaaaattgccagcgcatggctgccgtcatgttgcgatcattatggacggcaatggccgctgggcaaaaaagcaagggaagattcgtgcctttgggcataaagccggggcaaaatccgtccgccgggctgtctcttttgcggccaacaacggtattgaggcgttaacgctgtatgcctttagtagtgaaaactggaaccgaccagcgcaggaagtcagtgcgttaatggaactgtttgtgtgggcgctcgatagcgaagtaaaaagtctgcaccgacataacgtgcgtctgcgtattattggcgataccagtcgctttaactcgcgtttgcaagaacgtattcgtaaatctgaagcgctaacagccgggaataccggtctgacgctgaatattgcggcgaactacggtggacgttgggatatagtccagggagtcaggcaactggctgaaaaggtgcagcaaggaaacctgcaaccagatcagatagatgaagagatgctaaaccagcatgtctgtatgcatgaactggcccctgtagatttagtaattaggactgggggggagcatcgcattagtaactttttgctttggcaaattgcctatgccgaactttactttacagatgttctctggcccgatttcgatgaacaagactttgaaggggcgttaaatgcctttgctaatcgagagcgtcgtttcggcggcaccgagcccggtgatgaaacagcctgatgggggtcgcttttgctgaagtatcgcctgatatctgcttttgtgttaatacccgtcgtcatcgcggcgttgtttctgttgccgccggtggggttcgccattgtaacgctggtggtctgcatgctggcagcgtgggaatggggacagcttagcggttttaccactcgttcgcagcgagtatggttggcggtgttatgcgggttattgttggcgctgatgctttttctgttgccggaatatcaccgaaatattcatcaaccgctggttgaaatctcactttgggcttcgctgggttggtggattgtcgcgctattgctggtgctgttttacccaggttccgcagcaatctggcgtaactctaaaacattgcgccttatttttggcgtgctaaccattgttcccttcttctggggcatgctggcgttacgggcctggcactatgacgagaatcattacagtggcgcaatatggctgctctatgtcatgatcctggtatggggcgctgactccggcgcatatatgtttggcaaattgtttggtaaacataagctggcaccgaaggtttctccgggtaaaacctggcaaggctttatcggtggactcgctactgcagcggtaatctcatggggttatggcatgtgggcgaatctcgacgtcgctcccgtcaccttactcatttgctctattgtcgcagcgttagcctcagtgctcggcgatctgaccgagagtatgtttaagcgtgaagcaggaattaaggacagcggtcatttaattccaggacacggtggtattttagatcgtattgatagcctgacggctgcggtaccggtctttgcttgcttgttgttactggtattcaggacgctttaacggaaggtaatatgctgagttttctctgggatttggcttcgttcatcgttgcactgggtgtacttatcaccgtgcatgaatttggtcatttctgggttgcccggcgttgtggtgttcgcgttgagcgtttctcaatagggtttggtaaggcgctctggcggcgaactgataagctcggcaccgaatatgttatcgccctgatcccgttgggcggttatgtcaaaatgctggatgagcgcgcagaaccggtcgttccggaactccgccaccatgccttcaataataaatctgtcggccaacgagcggcgattattgccgcaggtccggttgcaaacttcatttttgctatctttgcctactggctggtttttattattggtgtgcctggcgtacgtccggtggttggcgaaatagcagccaattcgatagctgcggaagcacaaattgcaccaggtacggaactaaaagccgtagatggtatcgaaacgcctgattgggatgccgtgcgtttgcagttggtcgataaaattggcgatgaaagcaccaccattacagtagcgccatttggcagcgaccaacggcgggatgtaaagctcgatttacgtcactgggcgtttgagcctgataaagaagatccggtatcttcgctggggattcgtcctcgtgggccgcaaattgaacctgtactggaaaatgtgcagccaaactcggcggcaagcaaggcaggtttgcaagcaggcgacaggatcgttaaagtcgatggtcagcccttaacgcagtgggtgacctttgtgatgcttgtccgggataacccgggtaaatccttagcgttagaaatcgaaaggcaggggagtcccttgtctttgacattaatcccggagagtaaaccgggtaatggtaaagcgattggttttgtcggtattgagccgaaagtcattcctttgccagatgagtataaagttgtacgccagtatgggccgttcaacgccatcgtcgaagccacggacaaaacgtggcagctgatgaagctgacggtcagtatgctgggaaaattgatcaccggtgatgtgaaactgaacaacctcagtgggccgatctctatcgccaagggggctgggatgacagcggaactcggggttgtttattacctgccgtttcttgcgcttattagcgtgaacttagggataattaacctgtttccgttgcccgtacttgacggggggcatctgctgttccttgcgatcgaaaagatcaagggcggaccggtatccgagcgggttcaagacttttgttatcgcattggctcgattctgctggtgctgttaatggggcttgcacttttcaatgatttctctcggttatgagagttagttaggaagaacgcataataacgatggcgatgaaaaagttgctcatagcgtcgctgctgtttagcagcgccaccgtatacggtgctgaagggttcgtagtgaaagatattcatttcgaaggccttcagcgtgtcgccgttggtgcggccctcctcagtatgccggtgcgcacaggcgacacggttaatgatgaagatatcagtaataccattcgcgctctgtttgctaccggcaactttgaggatgttcgcgtccttcgtgatggtgatacccttctggttcaggtaaaagaacgtccgaccattgccagcattactttctccggtaacaaatcggtgaaagatgacatgctgaagcaaaacctcgaggcttctggtgtgcgtgtgggcgaatccctcgatcgcaccaccattgccgatatcgagaaaggtctggaagacttctactacagcgtcggtaaatatagcgccagcgtaaaagctgtcgtgaccccgctgccgcgcaaccgtgttgacctaaaactggtgttccaggaaggtgtgtcagctgaaatccagcaaattaacattgttggtaaccatgctttcaccaccgacgaactgatctctcatttccaactgcgtgacgaagtgccgtggtggaacgtggtaggcgatcgtaaataccagaaacagaaactggcgggcgaccttgaaaccctgcgcagctactatctggatcgcggttatgcccgtttcaacatcgactctacccaggtcagtctgacgccagataaaaaaggtatttacgtcacggtgaacatcaccgaaggcgatcagtacaagctttctggcgttgaagtgagcggcaaccttgccgggcactccgctgaaattgagcagctgactaagatcgagccgggtgagctgtataacggcaccaaagtgaccaagatggaagatgacatcaaaaagcttctcggtcgctatggttatgcctatccgcgcgtacagtcgatgcccgaaattaacgatgccgacaaaaccgttaaattacgtgtgaacgttgatgcgggtaaccgtttctacgtgcgtaagatccgttttgaaggtaacgatacctcgaaagatgccgtcctgcgtcgcgaaatgcgtcagatggaaggtgcatggctggggagcgatctggtcgatcagggtaaggagcgtctgaatcgtctgggcttctttgaaactgtcgataccgatacccaacgtgttccgggtagcccggaccaggttgatgtcgtctacaaggtaaaagagcgcaacaccggtagcttcaactttggtattggttacggtactgaaagtggcgtgagcttccaggctggtgtgcagcaggataactggttaggtacaggttatgctgttggtatcaacgggaccaaaaacgattaccagacctatgctgaactgtcggtaaccaacccgtacttcaccgtagatggcgtaagcctcggtggtcgtctcttctataatgacttccaggcagatgacgccgacctgtccgactataccaacaagagttatggtacagacgtgacgttgggcttcccgattaacgaatataactcgctgcgtgcaggtctgggttatgtacataactccctgtccaacatgcagcctcaggttgcgatgtggcgttatctgtactctatgggtgaacatccgagcacctctgatcaggataacagcttcaaaacggacgacttcacgttcaactatggttggacctataacaagcttgaccgtggttacttcccgacagatggttcacgtgtcaacctgaccggtaaagtgaccattcctggatcggataacgaatactacaaagtgacgttagacacggcgacttatgtgccgatcgatgacgatcacaaatgggttgttctggggcgtacccgctggggttatggtgatggtttaggcggcaaagagatgccgttctacgagaacttctatgccggtggttccagcaccgtgcgtggcttccagtccaataccattggtccgaaagcagtttacttcccgcatcaggccagtaattatgatccggactatgattacgaatgtgcgactcaggacggcgcgaaagacctgtgtaaatcggatgatgctgtaggcggtaacgccatggcggttgccagcctcgagttcatcaccccgacgccgtttattagcgataagtatgctaactcggttcgtacttccttcttctgggatatgggtaccgtttgggatacaaactgggattccagccaatattctggatatccggactatagtgatccaagcaatatccgtatgtctgcgggtatcgcattacaatggatgtccccattggggccgttggtgttctcctacgcccagccgttcaaaaagtacgatggagacaaggcagaacagttccagtttaacatcggtaaaacctggtaagtgttctccacaaaggaatgtagtggtagtgtagcgatgactttaggcgatcaatataagatcgccgggccacgcaaagaactgcaccctccggtgcaaatgggatggtaaggagtttattgtgaaaaagtggttattagctgcaggtctcggtttagcactggcaacttctgctcaggcggctgacaaaattgcaatcgtcaacatgggcagcctgttccagcaggtagcgcagaaaaccggtgtttctaacacgctggaaaatgagttcaaaggccgtgccagcgaactgcagcgtatggaaaccgatctgcaggctaaaatgaaaaagctgcagtccatgaaagcgggcagcgatcgcactaagctggaaaaagacgtgatggctcagcgccagacttttgctcagaaagcgcaggcttttgagcaggatcgcgcacgtcgttccaacgaagaacgcggcaaactggttactcgtatccagactgctgtgaaatccgttgccaacagccaggatatcgatctggttgttgatgcaaacgccgttgcttacaacagcagcgatgtaaaagacatcactgccgacgtactgaaacaggttaaataagtaatgccttcaattcgactggctgatttagcgcagcagttggatgcagaactacacggtgatggcgatatcgtcatcaccggcgttgcgtccatgcaatctgcacaaacaggtcacattacgttcatggttaacccaaaataccgtgagcatttaggcttgtgccaggcgtccgcggttgtcatgacccaggacgatcttcctttcgcgaaaagtgccgcactggtagtgaagaatccctacctgacttacgcgcgcatggcgcaaattttagataccacgccgcagcccgcgcagaacattgcacccagtgcggtgatcgacgcgacggcgaagctgggtaacaacgtatcgattggcgctaacgcggtgattgagtccggcgttgaactgggcgataacgtgattatcggtgccggttgcttcgtaggtaaaaacagcaaaatcggtgcaggttcgcgtctctgggcgaacgtaaccatttaccatgagatccagatcggtcagaattgcctgatccagtccggaacagtggtaggcgcagacggctttggttatgccaacgatcgtggtaactgggtgaagatcccacagattggtcgcgtaattattggcgatcgcgtggagatcggtgcctgcacaaccatcgatcgcggcgcgctggatgacactattattggcaatggcgtgatcattgataaccagtgccagattgcacataacgtcgtgattggcgacaatacggcggttgccggtggcgtcattatggcgggcagcctgaaaattggtcgttactgcatgatcggcggagccagcgtaatcaacgggcatatggaaatatgcgacaaagtgacggttacgggcatgggtatggtgatgcgtcccatcactgaaccaggcgtctattcctcaggcattccgctgcaacccaacaaagtctggcgcaaaaccgctgcactggtgatgaacattgatgacatgagcaagcgtctgaaatcgcttgagcgcaaggttaatcaacaagactaacgttccatcttttgttcgccaaactttacggcctgtctcattcttacgattgcggcaggccgtgttattattgtcgtttcttatattttgacaggaagagtatcttgactactaacactcatactctgcagattgaagagattttagaacttctgccgcaccgtttcccgttcttactggtggatcgcgtgctggattttgaagaaggtcgttttctgcgcgcagtaaaaaatgtctctgtcaatgagccattcttccagggccatttccctggaaaaccgattttcccgggtgtgctgattctggaagcaatggcacaggcaacaggtattctggcgtttaaaagcgtaggaaaactggaaccgggtgagctgtactacttcgctggtattgacgaagcgcgcttcaagcgcccggtcgtgcctggcgatcaaatgatcatggaagtcactttcgaaaaaacgcgccgcggcctgacccgttttaaaggggttgctctggtcgatggtaaagtagtttgcgaagcaacgatgatgtgtgctcgtagccgggaggcctgatacgtgattgataaatccgcctttgtgcatccaaccgccattgtggaagagggcgcgtcaattggcgcgaacgcacacattggtcctttttgtatcgttggaccccatgtcgaaattggtgagggtaccgtactgaaatctcacgttgtcgtgaatggtcatactaaaattggccgcgataatgagatttatcagttcgcctccatcggcgaagttaaccaggatctgaaatatgctggcgaaccgacccgtgtggaaatcggcgatcgtaaccgcattcgcgaaagcgtcaccattcatcgtggcacagtccagggcggtggattgacgaaggtgggcagcgacaacttactgatgatcaacgcgcacattgcgcacgattgtacggtaggtaaccgctgtattctcgccaacaacgcaacgctggcgggtcacgtatcggttgacgacttcgcgatcatcggcggcatgaccgcagtccatcagttctgcatcattggtgcgcacgtgatggttggcggctgctccggtgtggcgcaggacgtccctccttatgtcattgcgcagggtaaccacgcaacgccgttcggtgtcaatatcgaagggctgaagcgccgcggattcagccgtgaggcgattaccgctatccgcaatgcgtataagctgatttatcgtagcggtaaaacgctcgatgaagtgaaaccggaaattgctgaactggcggaaacatatccggaagtgaaagcctttaccgatttctttgcacgctcaacgcgcggtctgattcgttaatgactgaacagcgtccattaacgattgccctggtcgccggagaaacctccggcgatatcctgggggccggtttaatccgcgctctgaaagaacatgtgcccaacgcccgctttgttggtgttgccgggccacgaatgcaggctgaaggctgcgaagcctggtacgaaatggaagaactggcggtgatgggcattgttgaagtgctcggtcgtctgcgtcgcttactgcatattcgtgccgatctgacaaagcgttttggcgaactgaagccagatgtttttgttggtattgatgcgcctgacttcaatattactcttgaaggtaacctcaaaaagcagggtatcaaaaccattcattacgtcagtccgtcagtctgggcgtggcgacagaaacgtgttttcaaaataggcagagccaccgatctggtgctcgcatttctgcctttcgaaaaagcgttttatgacaaatacaacgtaccgtgccgctttatcggtcataccatggctgatgccatgccattagatccagataaaaatgccgcccgtgatgtgctggggatccctcacgatgcccactgcctggcgttgctaccggggagccgtggtgcagaagttgaaatgcttagtgccgatttcctgaaaacggcccagcttttgcgccagacatatccggatctcgaaatcgtggtgccactggtgaatgccaaacgccgcgagcagtttgaacgcatcaaagctgaagtcgcgccagacctttcagttcatttgctggatgggatgggccgtgaggcgatggtcgccagcgatgcggcgctactggcgtcgggtacggcagccctggagtgtatgctggcgaaatgcccgatggtggtgggatatcgcatgaagccttttaccttctggttggcgaagcggctggtgaaaactgattatgtctcgctgccaaatctgctggcgggcagagagttagtcaaagaattattgcaggaagagtgtgagccgcaaaaactggctgcggcgctgttaccgctgttggcgaacgggaaaaccagccacgcgatgcacgataccttccgtgaactgcatcagcagatccgctgcaatgccgatgagcaggcggcacaagccgttctggagttagcacaatgatcgaatttgtttatccgcacacgcagctggttgcgggtgtggatgaagtcggacgcgggccgttagttggcgcggtcgtcaccgctgcggtgatccttgacccggcgcgcccgattgccgggctgaatgattccaaaaagctgagcgaaaaacgccgtctggcgctctatgaagagatcaaagagaaagcgttgagctggagtctgggccgcgcggaaccccacgaaatcgacgagctgaacattcttcatgcgaccatgctggcgatgcagcgtgccgtcgctgggctgcatattgcgccggaatatgtgttgattgatggtaaccgctgcccgaaattaccgatgcctgcgatggctgtggtgaaaggcgatagccgcgtaccggaaatcagtgccgcgtctatcctggcgaaagtgacgcgtgacgccgaaatggcggcgctggatattgttttcccgcaatatggttttgcccaacacaaagggtacccaaccgcttttcatctggaaaaactggctgaacacggcgcgaccgaacaccatcggcgcagctttgggcctgtcaaacgcgcactgggacttgcgtcctgattcttgtgtcgagattaagtaaaccggaatctgaagatgtctgaaccacgtttcgtacacctgcgggtgcacagcgactactcgatgatcgatggcctggccaaaaccgcaccgttggtaaaaaaggcggcggcgttgggtatgccagcactggcgatcaccgatttcaccaacctttgtggtctggtgaagttctacggagcgggacatggcgcagggattaagcctatcgtcggggcagattttaacgtccagtgcgacctgctgggtgatgagttaacccacctgacggtactggcggcgaacaataccggctatcagaatctgacgttgctgatctcaaaagcgtatcagcgcgggtacggtgccgccgggccgatcatcgatcgcgactggcttatcgaattaaacgaagggttgatccttctttccggcggacgcatgggcgacgtcggacgcagtcttttgcgtggtaacagcgcgctggtagatgagtgtgtcgcgttttatgaagaacacttcccggatcgctattttctcgagctgatccgcaccggcaggccggatgaagaaagctatctgcacgcggcggtggaactggcggaagcgcgcggtttgcccgtcgtggcgaccaacgacgtgcgctttatcgacagcagcgactttgacgcacacgaaatccgcgtcgcgatccacgacggctttaccctcgacgatcctaaacgcccgcgtaactattcgccgcagcaatatatgcgtagcgaagaggagatgtgtgagctgtttgccgacatccccgaagcccttgccaacaccgttgagatcgccaaacgctgtaacgtaaccgtgcgtcttggtgaatacttcctgccgcagttcccgaccggggacatgagcaccgaagattatctggtcaagcgtgcaaaagagggcctggaagagcgtctggcctttttattccctgatgaggaagaacgtcttaagcgccgcccggaatatgacgaacgtctggagactgaacttcaggttatcaaccagatgggcttcccgggctacttcctcatcgttatggaatttatccagtggtcgaaagataacggcgtaccggtagggccaggccgtggctccggtgcgggttcactggtggcctacgcgctgaaaatcaccgacctcgatccgctggaatttgacctgctgttcgaacgtttccttaacccggaacgtgtctccatgcctgacttcgacgttgacttctgtatggagaaacgcgatcaggttatcgagcacgtagcggacatgtacggtcgtgatgcggtatcgcagatcatcaccttcggtacaatggcggcgaaagcggtgatccgcgacgtaggccgcgtgctggggcatccgtacggctttgtcgatcgtatctcgaaactgatcccgcccgatccggggatgacgctggcgaaagcgtttgaagccgagccgcagctgccggaaatctacgaagcggatgaagaagttaaggcgctgatcgacatggcgcgcaaactggaaggggtcacccgtaacgccggtaagcacgccggtggggtggttatcgcgccgaccaaaattaccgattttgcgccgctttactgcgatgaagagggcaaacatccggtcacccagtttgataaaagcgacgttgaatacgccggactggtgaagttcgacttccttggtttgcgtacgctcaccatcatcaactgggcgctggagatgatcaacaagcggcgggcgaagaatggcgagccgccgctggatatcgctgcgatcccgctggatgataagaaaagcttcgacatgctgcaacgctcggaaaccacggcggtattccagcttgaatcgcgcggcatgaaggacctgatcaagcgtctacaacctgactgcttcgaagatatgatcgccctagtggcactgttccgccccggtccgttgcaatcagggatggtggataactttatcgaccgtaaacatggtcgtgaagagatctcctatccggacgtacagtggcagcatgaaagcctgaaaccggtactggagccaacctacggcattatcctgtatcaggaacaggtcatgcagattgcgcaggtgctttctggttataccctcggtggcgcggatatgctgcgtcgtgcgatgggtaagaaaaagccggaagagatggctaagcaacgttctgtatttgctgaaggtgcagaaaagaacggaatcaacgctgaactggcgatgaaaatcttcgacctggtggagaaattcgctggttacggatttaacaaatcgcactctgcggcctatgctttggtgtcatatcaaacgttatggctgaaagcgcactatcctgcggagtttatggcggcggtaatgaccgccgatatggacaacaccgagaaggtggtgggtctggtggatgagtgctggcggatggggctgaaaatcctgccaccagatataaactccggtctttaccatttccacgtcaacgacgacggcgaaatcgtgtatggtattggcgcgatcaaaggggtcggtgaaggtccgattgaggccatcatcgaagcccgtaataaaggcggctacttccgcgaactgtttgatctctgcgcccgtaccgacaccaaaaagttgaaccgtcgcgtgctggaaaaactgatcatgtccggggcgtttgaccgtcttgggccacatcgcgcagcgctgatgaactcgctgggcgatgcgttaaaagcggcagatcaacacgcgaaagcggaagctatcggtcaggccgatatgttcggcgtgctggccgaagagccggaacaaattgaacaatcctacgccagctgccaaccgtggccggagcaggtggtattagatggggaacgtgaaacgttaggcctgtacctgaccggacaccctatcaaccagtatttaaaagagattgagcgttatgtcggaggcgtaaggctgaaagacatgcacccgacagaacgtggtaaagtcatcacggctgcggggctcgttgttgccgcgcgggttatggtcaccaagcgcggcaatcgtatcggtatctgcacgctggatgaccgttccgggcggctggaagtgatgttgtttactgacgccctggataaataccagcaattgctggaaaaagaccgcatacttatcgtcagcggacaggtcagctttgatgacttcagcggtgggcttaaaatgaccgctcgcgaagtgatggatattgacgaagcccgggaaaaatatgctcgcgggcttgctatctcgctgacggacaggcaaattgatgaccagcttttaaaccgactccgtcagtctctggaaccccaccgctctgggacaattccagtacatctctactatcagagggcggatgcacgcgcgcggttgcgttttggcgcgacgtggcgtgtctctccgagcgatcgtttattaaacgatctccgtggcctcattggttcggagcaggtggaactggagtttgactaatacaggaatactatgagtctgaatttccttgattttgaacagccgattgcagagctggaagcgaaaatcgattctctgactgcggttagccgtcaggatgagaaactggatattaacatcgatgaagaagtgcatcgtctgcgtgaaaaaagcgtagaactgacacgtaaaatcttcgccgatctcggtgcatggcagattgcgcaactggcacgccatccacagcgtccttataccctggattacgttcgcctggcatttgatgaatttgacgaactggctggcgaccgcgcgtatgcagacgataaagctatcgtcggtggtatcgcccgtctcgatggtcgtccggtgatgatcattggtcatcaaaaaggtcgtgaaaccaaagaaaaaattcgccgtaactttggtatgccagcgccagaaggttaccgcaaagcactgcgtctgatgcaaatggctgaacgctttaagatgcctatcatcacctttatcgacaccccgggggcttatcctggcgtgggcgcagaagagcgtggtcagtctgaagccattgcacgcaacctgcgtgaaatgtctcgcctcggcgtaccggtagtttgtacggttatcggtgaaggtggttctggcggtgcgctggcgattggcgtgggcgataaagtgaatatgctgcaatacagcacctattccgttatctcgccggaaggttgtgcgtccattctgtggaagagcgccgacaaagcgccgctggcggctgaagcgatgggtatcattgctccgcgtctgaaagaactgaaactgatcgactccatcatcccggaaccactgggtggtgctcaccgtaacccggaagcgatggcggcatcgttgaaagcgcaactgctggcggatctggccgatctcgacgtgttaagcactgaagatttaaaaaatcgtcgttatcagcgcctgatgagctacggttacgcgtaattcgcaaaagttctgaaaaagggtcacttcggtggcccttttttatcgccacggtttgagcaggctatgattaaggaaggattttccaggaggaacacatgaacatcattgccattatgggaccgcatggcgtcttttataaagatgagcccatcaaagaactggagtcggcgctggtggcgcaaggctttcagattatctggccacaaaacagcgttgatttgctgaaatttatcgagcataaccctcgaatttgcggcgtgatttttgactgggatgagtacagtctcgatttatgtagcgatatcaatcagcttaatgaatatctcccgctttatgccttcatcaacacccactcgacgatggatgtcagcgtgcaggatatgcggatggcgctctggttttttgaatatgcgctggggcaggcggaagatatcgccattcgtatgcgtcagtacaccgacgaatatcttgataacattacaccgccgttcacgaaagccttgtttacctacgtcaaagagcggaagtacaccttttgtacgccggggcatatgggcggcaccgcatatcaaaaaagcccggttggctgtctgttttatgattttttcggcgggaatactcttaaggctgatgtctctatttcggtcaccgagcttggttcgttgctcgaccacaccgggccacacctggaagcggaagagtacatcgcgcggacttttggcgcggaacagagttatatcgttaccaacggaacatcgacgtcgaacaaaattgtgggtatgtacgccgcgccatccggcagtacgctgttgatcgaccgcaattgtcataaatcgctggcgcatctgttgatgatgaacgatgtagtgccagtctggctgaaaccgacgcgtaatgcgttggggattcttggtgggatcccgcgccgtgaatttactcgcgacagcatcgaagagaaagtcgctgctaccacgcaagcacaatggccggttcatgcggtgatcaccaactccacctatgatggcttgctctacaacaccgactggatcaaacagacgctggatgtcccgtcgattcacttcgattctgcctgggtgccgtacacccattttcatccgatctaccagggtaaaagtggtatgagcggcgagcgtgttgcgggaaaagtgatcttcgaaacgcaatcgacccacaaaatgctggcggcgttatcgcaggcttcgctgatccacattaaaggcgagtatgacgaagaggcctttaacgaagcctttatgatgcataccaccacctcgcccagttatcccattgttgcttcggttgagacggcggcggcgatgctgcgtggtaatccgggcaaacggctgattaaccgttcagtagaacgagctctgcattttcgcaaagaggtccagcggctgcgggaagagtctgacggttggtttttcgatatctggcaaccgccgcaggtggatgaagccgaatgctggcccgttgcgcctggcgaacagtggcacggctttaacgatgcggatgccgatcatatgtttctcgatccggttaaagtcactattttgacaccggggatggacgagcagggcaatatgagcgaggaggggatcccggcggcgctggtagcaaaattcctcgacgaacgtgggatcgtagtagagaaaaccggcccttataacctgctgtttctctttagtattggcatcgataaaaccaaagcaatgggattattgcgtgggttgacggaattcaaacgctcttacgatctcaacctgcggatcaaaaatatgctacccgatctctatgcagaagatcccgatttctaccgcaatatgcgtattcaggatctggcacaagggatccataagctgattcgtaaacacgatcttcccggtttgatgttgcgggcattcgatactttgccggagatgatcatgacgccacatcaggcatggcaacgacaaattaaaggcgaagtagaaaccattgcgctggaacaactggtcggtagagtatcggcaaatatgatcctgccttatccaccgggcgtaccgctgttgatgcctggagaaatgctgaccaaagagagccgcacagtactcgattttctactgatgctttgttccgtcgggcaacattaccccggttttgaaacggatattcacggcgcgaaacaggacgaagacggcgtttaccgcgtacgagtcctaaaaatggcgggataacttgccagagcggcttccgggcgagtaacgtgctgttaacaaataaaggagacgttatgctgggtttaaaacaggttcaccatattgcgattattgcgacggattatgcggtgagcaaagctttctactgcgatattcttggtttcacgctgcaaagcgaagtctatcgcgaagcgcgcgactcatggaaaggggatttggcgcttaatgggcaatatgtgattgagcttttctcatttccgttcccgccggaacgacccagccgaccggaagcttgcggtctgcgtcatctggcttttagcgttgatgacatcgatgcggcagtggcgcaccttgaaagccataacgtgaagtgtgaaaccatccgtgtcgatccatacacgcaaaaacgcttcaccttctttaacgatccggacgggctgccgttggaactgtatgagcagtaaggcttgtcatcgccgcatttgcccggtaacgtgccgggcattgctactgtaaaatcgcaccatcatgacactcacgctcaatagacaacttctcacctcacgccagattctggtggcctttagcggcgggcttgactccaccgttctgctgcatcagttggtgcagtggcggacggaaaatccgggtgtcgctctgcgcgctattcatgtgcatcacggtttaagtgccaatgccgatgcctgggttacgcattgcgaaaacgtctgccaacagtggcaggtgccgctggtggtcgaacgcgtacaacttgcgcaagaaggactgggcattgaggcccaggcgcggcaggcacgttatcaggcatttgcccgcaccttgttgcccggtgaagtgctggtcaccgcgcaacatctcgacgatcaatgtgaaacctttctgctggcgctaaaacgcggcagtggccctgccgggctttcggctatggcggaagtctcggagtttgccggaacgcggcttattcgcccgttgctcgcccgcacgcggggggaactggtgcagtgggcgcgtcagtatgatttacgctggattgaagacgaaagtaatcaggacgactcatacgatcgtaactttctgcgcctgcgcgtagtgccgttattgcagcagcgttggccgcattttgccgaagcaacggcccgcagcgccgcactttgtgctgaacaagagagcctgctggatgaactgctggcagatgatttagcacactgtcaatcgccgcaggggacgctgcagattgtgccaatgctggcgatgagtgatgcccgccgcgcggcgattatccgccgctggctggcagggcagaatgcaccgatgccttcccgcgacgcgttggtgaggatctggcaggaagtggcgctggcgcgggaagatgcctcaccctgtttacgtttgggcgcgtttgaaatccgacgctatcagtcgcaactgtggtggattaaatccgtcaccgggcaaagcgaaaacattgtgccgtggcagacgtggcttcaaccgctggaattaccggcggggctgggaagtgtacagcttaatgcgggaggcgatattcgccctccgcgtgcagacgaagcggtcagcgtgcgtttcaaagcgccaggattgctgcatattgtcgggcgtaacggcggacgtaagctaaagaaaatctggcaagagctgggcgtgccgccgtggctacgtgacaccacgccactgctgttttatggcgaaacgctgattgcggcggcaggggtatttgtgacgcaagaaggtgtggctgaaggtgagaatggcgtaagttttgtctggcagaaaacgcttagttaagtgaaagccggataagacgcatcaaacgtcgcatccggcgaaagtcaatcaggattcgcttaccaccaccgtaccgatttccgggtggctaaagctggtaattttatccagacgcagctcgcgggtttcgccagcggcctcgacgaccaggtactccacatttttgcgggagactaaatcactggcttttgcctgcaatttttcgccatctttcagctcaagtgtcagcattaaatgatgctggcaggcgagctcaagattatcgtaatcatcacaattgattggttgatacgtatcattcattgacataatcgctcaccagtaagtttgccgcagcgtatgctgctttttccctgacagcctcagaaagggcgtcgtcggcagccatttcattcagcactttcaaaacgcagcccagcgcgtccggaacgtatcctaagtctccgctggcgatttccgcgtaccgcttgcgtattaactcacaatatttttccacatgccctcctgtcagcactctgacttaaccgtggatgcaagtctaagcctacgaagataaactctgtttcgcaaggtgactataccacactcatttctgcaatatcagcgccgcaactgcacgtattccgttacaatggcctcctgattcgaaaggagttttcttatggcgcttaaagcgacaatttataaagcgacggttaatgtggccgatctcgaccgcaaccagtttctcgatgcctctctgacgctggcgcgccatccttcagaaacccaggagcgtatgatgctgcgcttgctggcgtggctgaaatatgctgatgaacgtctgcaatttacccgtggtttgtgtgccgatgatgagccggaagcgtggctgcgtaacgatcacctgggcattgatttgtggattgagctggggctgccggatgagcggcggattaagaaagcctgcacccaggccgcagaagtggcgctgtttacctataatagtcgggcggcgcaaatctggtggcagcaaaatcagagcaaatgtgtgcagtttgccaatctttccgtctggtatctggacgatgaacaactggcgaaagtaagcgcctttgccgatcgtaccatgacgctgcaggcaacgattcaggatggcgtgatctggttatcggatgataagaataatctggaagtgaacttaaccgcctggcaacaaccttcatgattgtgatttcccgacatgttgctattcccgatggtgagcttgagatcaccgccattcgtgcgcagggcgcgggcgggcagcatgttaataagacctcaacggctattcatctgcgttttgacattcgggcgtccagcctgccagagtattacaaagagcgtctgctcgccgccagccatcatttgatcagcagtgatggcgtgattgtcattaaggcacaggaataccgcagtcaggaactgaaccgcgaagcagctctggcccggctggtggctatgattaaagaattaacaacagaaaaaaaagcccgacgacccacgcggcccacccgtgcatcgaaagagcgcaggctggcatcgaaagcacaaaaatcaagcgtgaaggcgatgcgcggcaaagtgcgcagcggtcgggaataaaaagaaggaatggatggtgaaaaaagcgatagtgacagcgatggctgtaatcagcctctttactctgatgggatgtaataatcgggccgaagtcgatacgctttctccggcgcaggctgccgaactgaaaccgatgccgcaaagttggcgcggcgtgctgccgtgtgccgattgcgaaggaatcgaaacctctctgttcctcgaaaaagacggaacatgggtgatgaatgagcgttatctcggtgctcgtgaagaaccttcctccttcgcttcctacggtacatgggcgcgaaccgctgacaagctggtattaaccgacagcaaaggtgaaaagtcatattatcgggcgaaaggcgatgcgctggagatgctcgatcgtgaaggcaatccgattgaatcgcagttcaactatacgctggaagcggcacaatccagtttacctatgacgccgatgaccctgcggggcatgtatttttatatggctgatgcggcgaccttcactgattgcgcgaccggaaaacgtttcatggtagcgaataacgcagagctggagcgtagctacctggctgcgcgcggtcacagtgaaaaaccggtgttactgtcagtagaaggtcactttacgcttgagggtaatccggataccggtgcgccgactaaagtattggcacccgatacggcagggaaattttaccccaaccaggattgcagtagtttggggcagtaacccgtcttgagacagaaacaaacgcaaaacaggccagaaggatatatttcaacattttgaatttgcacgttttttgtaggccggataaggcgtttacgccgcatccggcaatggtgctcaacgcctgatgcgacgctggcgcgtcttatcatgcctacaacccccctcataccttaaggcggataaggcatttactttatcaccgggtcaaaccaacaaagcgacccgccttgatataaatcccaggcttcaggtgcccaacatactgtaactgcgtttctggcttaaacgcagagacatcaccaatacgcatatgcatcagatcggcagggctaatccagcccgattgcgccagtgtaagtggatgcccggctttggcaaaggcatccgtgacaaattccgaacaaaaccacgactttttgtctccttcgcccacactgcttaactgcgctttcgccaggccgctgacgcactgttggcgaaaatcctcggagaacggattcagtgagcacatctggcgagtcaccataaagggaataaattcgacaatgccgcgatagttataaccgctatctttgattttattggcaaacgcggtgatatctgtggcttgttgcggggtaagatccgggactcgtaagacgaaaagcttatcactatgcttcatcgcttttttaagggaaacgatctggacgccagcgcctgtcgcttctgcaacgttattatcacccagaaagattgcaacgtgactcacagaggaagtgctgaagacgcggattccaaatgaggttaccccaaggcttgaggagaacagcaaatcgccgggtttgagatcaggtgccgttatttcttttattgattgttcggtgaaagagctttgatgctggaatttgacagcccatgtttttgcctcggcatctactgctgtggctgatgggtctggctggctgatatcaacggtacaagccgaaagtaaaagaaagctggggagaaacaggcggcagtacgcctttggtttatccattttatacaatccatgtaaaaaaagggccctgaaattcaggaccctttctggcatcagcctttaatctgtttcaccagatattcgacgatgtcaccagtcttaattaactgtttctcgccgttgcgacgatatttatattcgatatcgtcgttgtcgaggttacggtcgcccagcacaatagtgtgcggaataccgatcagttccatatcagcaaacatcacgcccggacgctctttgcggtcatccagcagcacttcgataccttgtgcacgcagttcgctgtacagtttctcagcaagctcttgtacgcggaaggatttgtgcatgttcatcggcagaatcgccacctggaacggcgcgatagcgtcaggccatacgatgcctcgttcgtcgtagttctgctcaatcgccgcagctaccacacgcgttaccccgataccgtagcaacccatcgtcaggatttggttacggccatcttcaccctgtacggaggctttcagtgcttcggagtacttggtacccagctggaagatgtgaccaacttcgataccacgtttgatcagcagcctaccctggccatccgggcttggatcgccagccaccacgttacggatatctgcaacttccggggtagcgacatcgcgatcccagttgatgccgaagtagtgtttaccatcgatgttagcaccagcagcgaaatcactcatcgccgcaacggtacggtcaatcaccaccggaatcggcatgtttaccggacccagtgaacccggaccggctttaaccacggcacgaatttcttcttcggtcgcgaaagtcagcgggcttgcaacctgcggcagtttttctgctttaacttcgttcagctcgtgatcaccgcgcaccagcagcgcaacctgcgggaagctgctgccttcaaccgctttaaccagcagagtcttaaccgttttctcaatcggcagattgaactgttcaaccagttccgcgatggttttcgcgttcggcgtatcaaccagcgtcatttcctgggtagcagcagcgcgcggttctttcggcgcgatagcttctgccagttcaatgttcgctgcatagtcagaggtgtcggagaagaccacatcgtcttcaccgctctgcgccagcacctggaattcgtgagaggcgctgccgccgatagaaccggtgtcggcttgtacggcgcggaaatccagccccatgcggctgaagattttgctgtaggccgcatacattgcatcgtaggtttcctgcagggattcctgagaagtatggaaagagtaagcatctttcatcaggaattcgcgggaacgcatgacgccgaaacgcggacgcacttcgtcgcggaacttggtctggatctgatagaagttcagcggcagctgtttgtaagagctaagctcgttacgaatcaggtcagtgataacttcttcatgagttgggccgagtacgaacggacgctcgccacggtcaacaaaacgcagcagttccggaccgtactgttcccaacgaccactctcttgccacaaatcggctggctgaaccaccggcatcgacacctcgatcgcaccggcgttgttcatctcttcacgcacgatgttttcgacttttttcagaacgcgcacgccggtcggcagccaggtatataacccggaggccagcttgcggatcatcccggcgcgcagcatcagctgatggctgatcacctcggcgtcggcaggtgtctccttgagagtggagagcaggtattggctagtacgcatgttgttacggttccagttggaaggtagaacaggctcaaggcgagcctgggacaaaaaaaagtgatttagtttaccagtgcaaaagaaatgtcaaaagagaagggcgtgaatttaacgcggttccagcgcaaagacttcaaaacctgcgtcggtgacgcgccagcgaacgttaaaatcatgtagccagacggcataggttttgcccgtttcctcacctttacgataggccgggcgcgggtcctgcgccagtacttcgcggataaacagcgttaactgcggataacgcttctccagcgtcaaaagctgcttttcgacctctgcggtaaaactcaccgccatctctgcagctggcgcactttgcgcatagctggcactggcatcgggaagcgattcggcaaaggggagatacggtttgatatccactaccggcgtaccatcgaccagatccagactgccgagcttcagaatcacgctgtctttatggcaaacaacctctttcagctctaccagcgacatgccaattgggttagggcggaaagtagagcgtgttgcgaaaacccccattctggcgttaccgccgaggcgcggtggacgcacagtcggacgccagccgccttccatcgtttgatgaaagacgaaaaggatccataaatggctgaacgcttccaggccgcgaacggcgtcggcctggttgtagggagcaatgagatgcagttcgccgttggcgctttttaccagacctggctggcgcggaacggcgaacttttctttatagggcgagcgaataacgcctatttgctcgaactggaaactgctcatttcgccgtaatgttaagcgcagaaccgatacatacagcctgacgatagcagcctggcgtaccgctggtgacttcgcagctatgcagtaatacagcattggctttcattttagaggcgttgatttgcatccgcttacgtgcggttggaatgctcggcggagagtcctgattagaggcctggcaagagtcgccactgacttcaccgagatcgcggaacggtttgccgactaattcttctgcattggtataaattcggaccggcgtggcgcgcggcgctttcggttttgcaggctccgctttcggctggggtgcagtgctttgaacgggttcgacaggggatctgcttaacatggaacagccgcttagcatgagtgctactaaacagatcggtaaagcacgcatagtatttcctcaatgtatgatcaaaacgtcaatattgaatcaggagcttgtaaaaatgacaagacgggcaagcgcccgtcctgaatgatattacaaattgtggaaacagcctaaaaattaccagcctttaacagctccgccgttaaacactttgtttgctgcttcgtaaacttcgtcagactgataagcctggacgaatttcttcacgttctcggcgtctttgttatcttcacgcgtcacgatcaggtttacgtacggggactctttatcttcaacaaagataccgtctttcgccggagtcaggccaatctggctggcataggtggtattgataactgccagagcgatttgcgcgtcgtccagagaacgcggcagttgcggtgcttccagttcaacaattttcagatttttggggttctcaacaacatcaagaacggtcggcagcaggccaacgccatctttcagtttgatcaagcccactttttgcagcagcagcagtgaacgaccaaggttagttgggtcgtttggcacggcaacctgcgaaccatcctgcagttcatccagtgatttgattttcttggagtaaccagcaatcggataaacaaaagtgttgcctactgcgaccagtttgtagccacgatctttcagttgctgatcaaggtacggtttatgctggaaggcgttggcgtcgatatcgcctttgctcaatgcttcgtttggcagaacatagtcgttgaaggttaccagctcaacgtccaggccatatttgtctttcgcaactttctgcgcgacttctgcaacctgctgttcggcaccaacaatcacgccgactttaatgtggtttggatctttttcatcctgaccgcagcctaccagtgccagtgatccgatcagggctcccactgccgcaaaggttttgaatttgaacgccataccttattccttcttcaattatttatgttgtgttgaacgttacttgcgagtgacagcccggacgatgcggtcgcctgcgaactgaattaaataaaccagaatgaccagcaataccagtaccgtattcatcaccgtcgcgttatagccgatgtagccatactgatagccaatctgacctaaaccaccggcaccgactgcaccacccatcgcggaataaccgaccagggtaatcagggtgatagttgccgcattcaccagacccggcagcgcttccggtaacagcaccttacggacgatctgcatcggcgtggcacccattgcgcgggaagcttcaattaacccggttgggatctccagcagagcgttctcgaccatacgggcaataaacggtgctgcaccaacggttaacggaacaatcgctgcctgcaaaccaatcgatgtaccgacaataacgcgggtaaacggaatcatccatacaagcaagataatgaacgggatggaacggaaaatgttcacaatcgcagaaacggtacgatacagcttcgcgttagcaataatttgccccggacgcgtgacataaagcagaacgccaaccggcagaccaatcacaaagccaaaaaaaccggatacgaaggtcattgccagcgtttcccatacgccacgaaccagcagccacatcatcggctcagacataacccagtacctctacttttacatggtgttcctgcagccaggcaatggcggcttgcgtatcttgttgtgtgccgtgcatttcagtcagcatgatgccgaacttaacgccaccggcgtaatccatctgcgcgctaataatgttgttgttgacgttgaaacgacgcgcggtttcagaaagcagtggggcatcgaccgattgaccggtaaactccagacgcagcatcggcacgcagtcagtaaatggctccgcttgcagacgttcctggtaatcttccgggatatccagatgcagggtcgactgaataaacttctgcgccagcggcgttttcggatgcgagaacacttcacttaccgtgtcctgctcgatcagttctccattgctgatgaccgccacgcaatcacaaatgcgcttcacaacgtccatttcgtgggtgatcaacagaatcgtcaaccccagacggcggttgatgtctttcagcagttcgagaatagaacgtgtcgttgccgggtccagcgcgctggtggcttcatcacacagcaatactttgggattgctggctaacgcacgggcaattgccacacgttgtttctgcccaccggaaagattcgacgggtagctatcatgcttatcgccaagaccaaccaatgacagcaattccgtcacgcgacgtttgacctcgtctttcggtgtgttgtccagctccagcggcagagccacgttgccaaaaacagtacgcgaagagagcaggttaaaatgctggaaaatcataccaatctggcggcgagctttggtcaactcggattctgacagcgtggtcagttcctggccatcgaccagcacgctaccctcggttgggcgctccagcaggtttacacaacgtataagcgtactcttacccgcgcctgaggcaccgataacgccataaatttgtccagctggcacatgcaggctgacgttgttcaacgcctggatggtgcgggtgccctggtggaacactttggtgatattcgaaagttttatcattgattatttattatcgtcattaagttagtcgtggcatctcgaatgcctgaaacgggcaacgccgtcaatgaaatggatgttaaggcatccagacgtctaaatcaatcaggtttatgcgaagagcactttcttgcaggtcgaaacatgcgatactagcgtcacatgccttattaaggagctataaaaggtggcgaagagcgtacccgcaatttttcttgaccgtgatggcaccattaatgtcgatcacggctatgtccatgagatcgacaactttgaatttatcgacggtgttattgacgccatgcgcgagctaaaaaaaatgggctttgcgctggtggtagtaaccaaccagtctggcattgctcgcggtaaatttaccgaagcacagtttgaaacgctgaccgagtggatggactggtcgctggcggaccgagatgtcgatctggatggtatctattattgcccgcatcatccgcagggtagtgttgaagagtttcgccaggtctgcgattgccgcaaaccacatccggggatgcttttgtcagcacgcgattatttgcatattgatatggccgcttcttatatggtgggcgataaattagaagatatgcaggcagcggttgcggcgaacgtgggaacaaaagtgctggtgcgtacgggtaaacctattacgcctgaagcagaaaacgcggcggattgggtgttaaatagcctggcagacctgccgcaagcgataaaaaagcagcaaaaaccggcacaatgattaaaagatgagcggttgaaataaaaatgcatttttccgcttgtcttcctgagccgactccctataatgcgcctccatcgacacggcggatgtgaatcacttcacacaaacagccggttcggttgaagagaaaaatcctgaaattcagggttgactctgaaagaggaaagcgtaatatacgccacctcgcgacagtgagctgaaagccgcgtcgcaactgctctttaacaatttatcagacaatctgtgtgggcactcgaagatacggattcttaacgtcgcaagacgaaaaatgaataccaagtctcaagagtgaacacgtaattcattacaaagtttaattctttgagcatcaaacttttaaattgaagagtttgatcatggctcagattgaacgctggcggcaggcctaacacatgcaagtcgaacggtaacaggaagaagcttgcttctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcttttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagcgtactttgcagtgctcacacagattgtctgatgaaaatgagcagtaaaacctctacaggcttgtagctcaggtggttagagcgcacccctgataagggtgaggtcggtggttcaagtccactcaggcctaccaaatttgcacggcaaatttgaagaggttttaactacatgttatggggctatagctcagctgggagagcgcctgctttgcacgcaggaggtctgcggttcgatcccgcatagctccaccatctctgtagtggttaaataaaaaatacttcagagtgtacctgcaaaggttcactgcgaagttttgctctttaaaaatctggatcaagctgaaaattgaaacactgaacaatgaaagttgttcgtgagtctctcaaattttcgcaacacgatgatggatcgcaagaaacatcttcgggttgtgaggttaagcgactaagcgtacacggtggatgccctggcagtcagaggcgatgaaggacgtgctaatctgcgataagcgtcggtaaggtgatatgaaccgttataaccggcgatttccgaatggggaaacccagtgtgtttcgacacactatcattaactgaatccataggttaatgaggcgaaccgggggaactgaaacatctaagtaccccgaggaaaagaaatcaaccgagattcccccagtagcggcgagcgaacggggaggagcccagagcctgaatcagtgtgtgtgttagtggaagcgtctggaaaggcgcgcgatacagggtgacagccccgtacacaaaaatgcacatgctgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagcatgcttaggcgtgtgactgcgtaccttttgtataatgggtcagcgacttatattctgtagcaaggttaaccgaataggggagccgaagggaaaccgagtcttaactgggcgttaagttgcagggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaagctatttaggtagcgcctcgtgaactcatctccgggggtagagcactgtttcggcaagggggtcatcccgacttaccaacccgatgcaaactgcgaataccggagaatgttatcacgggagacacacggcgggtgctaacgtccgtcgtgaagagggaaacaacccagaccgccagctaaggtcccaaagtcatggttaagtgggaaacgatgtgggaaggcccagacagccaggatgttggcttagaagcagccatcatttaaagaaagcgtaatagctcactggtcgagtcggcctgcgcggaagatgtaacggggctaaaccatgcaccgaagctgcggcagcgacgcttatgcgttgttgggtaggggagcgttctgtaagcctgtgaaggtgtactgtgaggtatgctggaggtatcagaagtgcgaatgctgacataagtaacgataaagcgggtgaaaagcccgctcgccggaagaccaagggttcctgtccaacgttaatcggggcagggtgagtcgacccctaaggcgaggccgaaaggcgtagtcgatgggaaacaggttaatattcctgtacttggtgttactgcgaaggggggacggagaaggctatgttggccgggcgacggttgtcccggtttaagcgtgtaggctggttttccaggcaaatccggaaaatcaaggctgaggcgtgatgacgaggcactacggtgctgaagcaacaaatgccctgcttccaggaaaagcctctaagcatcaggtaacatcaaatcgtaccccaaaccgacacaggtggtcaggtagagaataccaaggcgcttgagagaactcgggtgaaggaactaggcaaaatggtgccgtaacttcgggagaaggcacgctgatatgtaggtgaagcgacttgctcgtggagctgaaatcagtcgaagataccagctggctgcaactgtttattaaaaacacagcactgtgcaaacacgaaagtggacgtatacggtgtgacgcctgcccggtgccggaaggttaattgatggggttagcgcaagcgaagctcttgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggctttgaagtgtggacgccagtctgcatggagccgaccttgaaataccaccctttaatgtttgatgttctaacgttgacccgtaatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgactccttgagagtcctgaaggaacgttgaagacgacgacgttgataggccgggtgtgtaagcgcagcgatgcgttgagctaaccggtactaatgaaccgtgaggcttaaccttacaacgccgaagctgttttggcggattgagagaagattttcagcctgatacagattaaatcagaacgcagaagcggtctgataaaacagaatttgcctggcggccgtagcgcggtggtcccacctgaccccatgccgaactcagaagtgaaacgccgtagcgccgatggtagtgtggggtctccccatgcgagagtagggaactgccaggcatcaaattaagcagtaagccggtcataaaaccggtggttgtaaaagaattcggtggagcggtagttcagtcggttagaatacctgcctgtcacgcagggggtcgcgggttcgagtcccgtccgttccgccacttattaagaagcctcgagttaacgctcgaggttttttttcgtctgtatatctattattgccagaatcgcaaaaatcctctgcattttacgctctttttcctcaacagtctgaagcccataatcacctcagttaacgaaaatagcattaaaagaggcatattatggctatccctgcatttggtttaggtactttccgtctgaaagacgacgttgttatttcatctgtgataacggcgcttgaacttggttatcgcgcaattgataccgcacaaatctatgataacgaagccgcagtaggtcaggcgattgcagaaagtggcgtgccacgtcatgaactctacatcaccactaaaatctggattgaaaatctcagcaaagacaaattgatcccaagtctgaaagagagcctgcaaaaattgcgtaccgattatgttgatctgacgctaatccactggccgtcaccaaacgatgaagtctctgttgaagagtttatgcaggcgctgctggaagccaaaaaacaagggctgacgcgtgagatcggtatttccaacttcacgatcccgttgatggaaaaagcgattgctgctgttggtgctgaaaacatcgctactaaccagattgaactctctccttatctgcaaaaccgtaaagtggttgcctgggctaaacagcacggcatccatattacttcctatatgacgctggcgtatggtaaggccctgaaagatgaggttattgctcgtatcgcagctaaacacaatgcgactccggcacaagtgattctggcgtgggctatgggggaaggttactcagtaattccttcttctactaaacgtaaaaacctggaaagtaatcttaaggcacaaaatttacagcttgatgccgaagataaaaaagcgatcgccgcactggattgcaacgaccgcctggttagcccggaaggtctggctcctgaatgggattaagcctctctgacagctcctccgggagctgtttttacatgctcgctaaggaaatcgataaaagcccggatgcgcgtacttaccgcacggtcgctgtaatagacggcactgaatggcatttccactggcaacactttatctgccattaactccaccaattctccgcgagcgatttctttgtcgatcatgtagtcggacaaacacgcaatcccgttgccactcaggcaaagctgtttcagtgtttccccactattggatgacaaaccgtacttcacctcatgtaattgtccatcgctacgggctatcggccaggtattgagggaagcgggttcagtgaatcccaggcaaatatgttgctttaaatcgtcgatcgtttctggcttcccgtagcgggaaatataatcgggggaggcgataatttttcgataactgttaaataacggcctggcacgtaagctggaatccgttaacgtaccagcgcgtatcgcgacatccacttttctttcgatcaaattaataatcgtttcggaggagactagcgacaaagtgacttccggatagcgttcacggaaaggcttaattaacggcatcagaaagtgcagcaccactggagttgcggcatcgatccgtaacagtccacgcggtgtattacgcgtctccataatttctgattctgccgctgccatctcctgcaaaattgactgtacgcgacgaaaataacgctcgccttcttccgtcaggctaagttgtcgcgtggtccgattaagcaggctaacgccaagtttcatctccagctttttcaccgcccggcttaccgctgagtttgcttgccctaattgttccgctgcccggctaaagctgccgctttcgacgaccgaaacaaaaatggcgagttcttccgacgtggctttcatttttgctcctgttgcaaaatagaagagatattttgaatttatttgtcattaaaccatcaggatgcgtgatatgtcatgcgatttaatgttctccataatgagcaaaattctgaccggtgtaagcacttgcttacataacaatatacaattgctcgttgaaagagtgagctaaaatccctataacagtagaaccctcccgagtgcggaagggttgacgtaatagaggtttcaaagtcaaaagtgcgaaaaaacacctatgccatgcgctatgttgccggacaacctgcggaaaggatcttaccgccggggtcttttgcgagcatcggccaggcattaccacctggggaaccgttaagtaccgaagagcgtattcggatcctggtgtggaacatatacaaacagcaacgcgctgaatggttgtcggtattaaagaactacggcaaagatgcacatctggtgttattgcaggaagcgcagacaacgccagagttagtacagtttgcgaccgctaactatcttgccgccgatcaggtacccgctttcgtgctgccacaacatccttctggcgtaatgaccctttcggcggcacatccagtgtattgctgcccgttacgtgaacgagaacccattttgcgtctggcgaagtcggcactggtgacggtctatccattacctgacacccgcctgttgatggtggttaatatacacgccgtcaacttcagtctgggcgtggatgtctatagtaagcagttacttcctattggcgatcagatagctcaccacagcggcccggtcattatggcgggagatttcaatgcctggagccgtagaaggatgaacgcgttatatcgctttgcgcgggaaatgtcgctgcgccaggtgcgttttaccgatgatcagcgccgtcgggcgtttggtcgcccgctcgattttgttttctaccgtggtctgaacgtcagtgaagcttctgtactggttacgcgcgcttccgatcacaatccgctactcgttgaattcagtcccggcaagcctgataaataaggtatgtcaggtctgccacagggcagaccaacgtttggcgctgcgcaaaacgtgagcgcggtggtggcgtatgacttatctgcccacatgctggatgtcgtggcacaagctgccgaagcccggcaactgaaaaatatcaccacccgccagggatatgccgaaagtctgccatttgccgataacgcatttgatattgttatcagccgttattctgcccatcactggcatgatgttggtgcagcactgcgagaagtgaataggatattgaaacctggcggtaggctgattgtgatggacgtaatgtctccgggtcacccagtgcgcgacatctggttacagacggtagaagcattacgcgatacctctcacgtacgaaactacgccagcggtgagtggttgacgttaatcaatgaagccaatctgatagttgataatttaattacagataagttaccgctggaattttcttcatgggtcgcgagaatgcgtacgccagaagcgttagtagacgctattcgcatttaccaacagagcgcatcgacagaggtgagaacgtattttgccttgcagaatgatggctttttcaccagtgatatcatcatggtagatgcacataaagcggcataaataaaaaaggcaccgggggaatcggtgcctttttattatctggtttgtcaggaatctggcatgttgttgtttttcacaaacaacgtcagcttatcgcctggttgcagattcgcagtgtcgctgttccagcgcatcacatctttgatgttcacgccgtggcgtttagcaatgcttgaaagcgaatcgcctttgcgcacacgatacgtaatgctatcgctgttgtttgccagtcgctgtgcgctactgcctgcaccaatcgtcaaactttggcctggcttcagcttagatccgcgcagtttgttccactgctgcaaatctttggtgcttacgccgagacgtgaagcgatacttgaaagcgtgtcgccagagcgtacggtgtaaacacggctgttaagcggcgtattgtcggcaaccagcgtcgactgtacagcagcaatttcgcctgaagccagagattcacgcagttgatctgcatgcttctttggcaccatcacgtactgcgggccacttgcgcccagcgtggagccttttacgccagcgttgaatgtcttcagcttgctgacggaaatccccgccatatctgctaccttcgccatttcaaccgggctgctcaggtgcacacgcgccagagcacggctttcatcggtcgttggcagacgtacgccataacgcttgctgtttttgagaatatcactcaatgccagcattttaggcacgtactgcttcgtttcctgcggcaacggtaacgaccagaagtccgtggatttcccacgcgctttgttcgttttaattgccttcatgacccgaccttcgccgctgttataagccgctacggtcagaagccagtcgccgtcaaacattttgttcagacgctgcatcatattcagcgcggcagttgttgaagcaacaacatcgcgacgcgcgtcataattgcgggtctgtttcaaaccataattgcgccccgtgctcggaatgatctgccagatgcctgcggcattggcgccagacgttgcgtgaggatcaaaagcgctctccactatgggtagtagtaccagttccataggcatgttacgttttttaacttgccctgctatccagtacatatacggctctgcccgtaaagttacatcgtggagatagctcttattgcgtaaatatttctgtttctgttcgcgaatccggtcattttccggaattcccatctttagctcgtcgccaatgaaagcccacaagtcaccatctggcgcgatagacgtcccatcgtccatccatcgtgcctgacttgtaaactttgctgcttccccttgaccagctgcagaaaggctctgtgcgtgctgttgaacgttgccggtactctggcaacccacgagcaggacagaggcgagtaatatcgcttttgccttcatgtgtgtgtcaatagttgcttaaaagacgaccgatcataacggcgaacggagccgatgacaagaaagttttatcagaacctatctttctttgaccttaaccatgcaaaacgctcttcaggttgttgcaataatgtttcttcattaattacattaattaaatcaatatcttccgttcttaaaaaaacattaatttgccgctcatttttcagaattacgggtagtgttatttgattttttgcccgtaactccttaactttacgataataatcatttatggacaaatcgtgcggaagaatactcaaagcaaacttcatatttgataaggtatattcatgagcacaacataccaatgtatcgtcaggtaacgcacttaactttttaagtgattgatacatttgtgatgctgtcccttcaaacaaccgaccacacccaccagaaaacagtgtgtcgccgcaaaatagataaggtttactgaagtaacagatatgtcctaaagtgtgacccggcgtagcaattacactaaattcatgccccaaaacgaaggcagtttcgccatctttgactacctgtgttgttcccttatcttgtgtctcttgtggaccatacaccacaatttgtggaaacttttccaccagttcttttacgccgccaacgtgatcgtggtgatggtgggtgagaaatatggcctccggttgccagttattggcggcaatggcgtttaatactggctctgcgtctccgggatcgacaatcaggcagcgacctgcttcatcattcaaaacccagatgtaattgtcatcaaaggcgggaatactgttaagattcatagattacctctcagtgtgaaacggaaggttgtgatgaaaccggcaagagtccctcaaactgtcgtggctcctgattgctggggcgatttgccctggggaaagctttatcgcaaggcgctggagcgccagctcaacccgtggttcactaaaatgtatggttttcatctgcttaagattggcaatttaagcgcagaaatcaattgcgaagcgtgcgcggtttctcatcaagtgaatgtttctgcgcaaggaatgcccgtccaggtacaggcggacccacttcatcttccttttgccgataaatccgttgatgtttgtctactggcacatacattgccgtggtgcaccgatccgcatcgtttattgcgtgaagccgatcgggtattgattgatgatggctggctggtcattagtggcttcaatcccatcagttttatgggattacgcaaacttgtgccggtattgcgcaaaacctcgccctataacagccggatgtttactctgatgcggcagctggactggctctctttgttgaattttgaagtgctacacgccagccgtttccacgttctcccgtggaacaaacacggaggaaaactattgaatgcgcatattcctgcgcttggttgcttacaacttattgttgcccggaaacggactattcctttaacgctaaatccgatgaaacagagtaaaaacaagccacgaattcgccaggcggttggagccacccggcaatgtcgtaaaccacaggcttaaacttcaacttggtagcctgtatcttccagtgtgggattcatcgccgcggcacgagccagttcatcacagcgttcgttttccgggtgtccggcatggcctttaacccattcccatttgatttgatgctgccccaatgcagcatcaagacgttgccagagatcgacattttttactggttttttgtctgcggttttccagccacgttttttccagttatggatccactgggtgataccctggcggacatactggctgtcggtactcaaaatgacttcgcaatgttcttttaacgcctccagcgcgacaatagcggccatcaactccatacggttgttggtggtgcgggtgtagccagcgctaaaggttttctcgcgtccgcgatagcgtaaaatagcgccgtaacccccaggtcctggattgcccagacacgaaccatcggtgaaaatttctacctgtttaagcatctctggtagacttcctgtaattgaatcgaactgtaaaacgacaagtctgacataaatgaccgctatgagcactgcaattacacgccagatcgttctcgataccgaaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataaatacctgtgaaaggcgctaaaaatagcgacttgggcgatttttgcagcaaacgattcaaaagatgagaaaaaccgttgacgaaggtcgaggcaatccgtaatattcgcctcgttcccaacggaacacaacgcggagcggtagttcagtcggttagaatacctgcctgtcacgcagggggtcgcgggttcgagtcccgtccgttccgccactattcactcatgaaaatgagttcagagagccgcaagatttttaattttgcggtttttttgtatttgaattccaccatttctctgttcaatgattttactctggcgtaggtgcgtgattctcgcttgttgtctcattcattaaaattcaataatgatatcgaaccattcagcttaaatatatttctagagaataaatttatattgattaaatgaatgtatatttcaaattgattttgtttgttattatttaagtgaggtatataattagagtccgttatcaatgctaaatattctaatcattatgacaggcgagggagtgtccaattatgaattcaaaaaagctttgttgcatatgtgtgttattctcgctgcttgcaggatgtgcctctgaatcttctattgatgaaaagaagaaaaaagctcaagtcacacaaagtaatattaataaaaacactccccagcaactgacagacaaagatttattcggtaatgaaaccactctggccgtatccgaagaggatattcaagctgcgcttgatggagatgagttccgcgttccccttaattctcctgtaatacttgttcaatccggcaaccgcgcaccggaaaccattatgcaggaggagatgcgaaaatattatactgtttccacattctctggtatcccggacaggcaaaagcctctgacttgtaacaaaaacaaagataaaaatgagaacgaggatgttgccagtgctgagaatatgaactggatgcaggcactgcgttttgtggctgcaaaaggacatcagaaagcgattattgtttaccaggatatgttgcagacaggaaaatatgactctgcgctgaaatcaacagtatggtccgactataaaaatgacaaactcactgacgctatctccctgcgctacctggtacgtttcacgctggtggatgtggcaacaggtgagtgggctacctggtcgccggtgaattatgaatataaagtgcttccaccattgcccgacaagaatgaagccagtacgactgatatgacagagcagcaaatcatgcaacttaagcaaaagacctataaagcgatggtaaaagatttggttaaccgctatcaataataaattatatctgccgccaggaatttctggcggcaataatacaaaattctttgcataagaaatttttcttgacaaagacagtgcaagaaaggacatggaatccggagttaaaaactgtttgttttagaatatttaattatttaactgctgaatcttccttgcgagaaatatatccattattacatttcatgccatttttaatatagattgctcctgggaaaattcccgtattattaccgcaggggtgataattagtattgacatatcctgtgacaaaaggagctattaaaggtgctattacgatagctattagtaaaaatataagagttagctgtattgttatgtctgtggcgaaattgactaccttcgtttttttgattaagaatgattttattatcgtaagtaaaattacatgaatatttaaaaaggaaaacgacatgaaaccgaagcacagaatcaacattctccaatcataaaatatttccgtggagcattttattattgaatatagaggtttaactccggtaaaaaacaaagaagcattgaatgcagggaaaaataatatggccataaaaaacatcgaaagaaactcttttaatttaacatgtaaacgcatggttaatcctcatatcacgggtggagtgttaagaacatacataaatggagtcatgttttcccttttccatttatcaagttcctgttgccgttttagtccatctctaattgcatattttaatttttctgataaatggcattgagcatcgatttcatttaaaacaactgtacacactatccctgtcagtaaaattgctcctccgacaagaattactggaaagccaaagctaacacaggcaaaagaagccagacttccaatagcggttgcaacaccaccggctataactgctttggccacatccattgaaaaatcgccaagaaaattaaccagatctcgctctgaactcataataaattctatggttctgctgatttaaccgcagagaagttcgccacagcaatccgaaaccactggcacgtggagaataagctgcacaggcgtctggacgtggtaatgaatgaagacgactacaaaataagaagaggaaacgcagcagaattattttcagggatacggcacattgctattaatattttgacgaatgagaaggtattcaaggcagggttaagacgtaagatgcgaaaagcagccatggacagaaactacctggcgtcagtccttgcggggagcgggctttcgtagtaataccccgactctccccgtccttaaacacaacccccactcaccacaacctaaactcatccgcatcctgccatgccggaaacttttctctatattcccgcaatgctgccatcgacagctccgcatcaatgcgcgttgcctgatgcgcgtcggcagtagcgataatctctccttgcggattaatcacccggctgtcaccgcgataatggcagccgttgccatcgctgccgacgcgattgcatcccgccacatacgcctgattctcaatcgcgcgggccgtcagcaatgcctgccagtgcagagagcgcggagcaggccagttggcgacgtacagggcgaggtcataatcgttgagattgcgcgaccacacaggaaaacgtaagtcgtagcacaccagcggcaaaatacgccagccgcgccattccacaatcactcgcgcattgcccgctttataatgtagatgctcatctgccatgcggaacagatgacgcttatcataaaaatgtaccgtgccgcccggctcaaccagcaaaaagcggttaaccgaaccagactccgtttgtaatgcaacactgcctgcaatcagcgcattgcactgctgcgccttagctgtcatccagttcactacgtcatcttgtgctagcgacgaagctgccgcttccatggcaaagccgctggtaaacatctccggtagaacgatcacatcgcgcccggtaataccttccagttgacgatcaaaatgacgcaggttggcaggaccatccatccacaccagtggttgctgcaaaagcgtaatcttcaaaccaggcacggtgtacaactcctttatgcgaagggttttataactttaacaccttatcaggcagttgccttagcgcagaataaattgataacaaatgctgatattggaaatatctgatttgcaaattatcgtgttatcgccaggctttaggaggttaataacatgggcaggataagctcgggaggaatgatgtttaaggcaataacgacagtcgccgctctggtcatcgccaccagtgcaatggcgcaggatgatttaaccattagcagccttgcaaagggcgaaaccaccaaagctgcatttaatcagatggtacaagggcataagctgcctgcctgggtgatgaaaggcggtacttatactcccgcacaaaccgtaacgttgggagatgagacgtatcaggtgatgagcgcgtgcaaaccgcatgactgtggctcgcaacgtatcgctgtgatgtggtccgagaaatctaatcagatgacggggctgttctcgactattgatgagaaaacgtcgcaagagaaactcacctggctgaatgtgaacgatgcgctttcgattgatggtaaaacggtgttgttcgcggcgttgaccggcagcctggaaaaccatccggatggctttaattttaaataattagcggataaagaaacggagcctttcggctccgttattcatttacgcggcttcaactttccgcactttctccggcaactttaccggcttcgtcgccagctcttccggatcaaagtcatcaacgttaatactgcgcagacggctttcttcagctttcaccagaatagcggcttcatctttatcaatcagccccttcaccagcgcgttgtgcgccagttcatccagacgggtaaacggcaggtttttacccagctctttacagatccgctgatgaattgggtcggcggcaatcacatccaccagcgcctcttccagcaagccaaccggattatgctcgctcggcgtcaggtactgaccgcgaccaatgcgggaacgggtggcgttcggcacttgtaaaatcttcgccactttatgatccagcttgtcagaaggtgccagataatgacgtccggtcgggaagatcaccacattcagcagcccggcaaccacgcggttcgggaagttttgcagtaaatcatccatcgcctgttcagcctgatacagcgcatcttgtacgccccagtgcaccagcggcaggtcggcttcattacggccttcgtcgtcataacgcttcagcacggcagaggcgaggtagagctggcttaaaatatcccccagacgggccgagatgcgctcgcgacgtttcaggctgccgcccagcactgccatcgagacatcagaaagcagggcgaggttggcgctcaggcggttcaggtgctgatagtagcgtttagtggcatcgccggttggcgtgctgctggttaaaccgcgcgtcaggcccagccagaagctgcgaactttgttgctaccgacgtgaccgatatgtttgaacaacagtttatcgaacgcgttgacgtcattgttcttcgccgcttccatctcttccagcacgtacggatggcaacgaatcgctccttgtccgaagatcatcatgctgcgggtcagaatgttagccccttcaacggtgatggcaatcggtgcgccctggtaagcacgcgccaggaagttgctttgcccgagcataatgcctttaccgccggtaatatccatcgcatcaataatcgactgctgcccgcggtgggtacagtgatacttaacgatagccgacagcacggcaggtttttcgccgagcataatgccgtaggtaatcagcgatgccgcagcatccatcacgtaggcattaccggcaatacgcgccagcggctcttcaatcccttccatcttaccaatagagattttgaactgacggcgaatgtgagcatacgcgccggttgccagcgctaccgatttcacgccgccggttgagttggaaggcagggtgatgccgcggcctaccgagaggcactccaccagcatccgccagccttgcccggccattttcggcccgccgatgatgtaatcgatcggcacgaagacatctttaccgcgcgtcggtccgttctggaacggtacgttcagcgggaagtggcgacgaccaatttccacgcccggcgtggtggttgggatcagcgcacaggtaatgcctaaatcttctgcaccgccgagtaatttttccgggtcggagagtttaaacgccagcccaagcacggtcgcaatcggtgccagcgtaatgtagcgtttgttccaggtcagacgcatccccagcacctgctggccctgccattcgcccatgcagacaatcccggtgtccggaatcgcgcccgcatcggaacccgcttccgggctggtcagtgcaaagcaggggatctcctgaccacgcgccagacgcggcagatagtgatctttctgctcgtcagtgccgtaatgttgcaacagttcgcccgggcctaatgagtttggcacgccgacggtaatcgccaggatcccgctcacgccggagagtttttgcagcacgcgagactgggcataagccgagaactccagcccgccgtactcttttttgatgatcatcgcgaagaaacgatgctctttaaggtacgcccacaactccggcggcagatccgccagctcatgggtgatctggaaatcattcgccatccggcaggcttcttctaccgggccgtcgagaaacgcttgctcttcggcggtcaggcgcggctgcggatagttatgcagctttttccagtccggcttgccctggaacaagtcgccctcccaccaggtggtgcccgcatcaatcgcttctttctcagtgcgcgacatcggcggcatcaccttacggaaaccgcgaaataccggcgcggaaatcatcgacttacgcataggcgcaaagttaaatggcacgaggataatggccagaggcaccagtacccacgccgaccacagaccagcaacgccgagggcggctgtccaggcgagcaaaatcagactgctgataaataagctcacgcggtgatagaacaacgcgccgagcaggacaaccgtagcgagaatactcaaaatcatcataacgaaaagccccttacttgtaggaggtctgaccacttgtgatgatatggttgtagtggatgtaaaaacatttagcaatatgtttacaatataattacaacaaagctcacattgttgctgtttttatccgcacttcaggtcaaaaagtcctggtcatagcacctgcccgtacttctcgcttttggcggtatccggtacactgcattttgtctattacatttatgctgaaggatatcctcatgtaccaggatcttattcgtaacgaactgaacgaagcggcggaaacgctggctaactttttaaaagatgacgccaatattcacgccattcagcgcgcggcggtcctgttagcagacagctttaaagccggtggcaaagtgctttcctgcggcaacggcggttcccattgcgacgctatgcactttgccgaagagttgaccggtcgctaccgtgaaaaccgtccgggctacccggcgattgctatttctgacgttagtcatatttcctgcgtcggtaatgatttcggtttcaatgatattttctcccgctacgttgaagcggtaggtcgcgaaggcgatgtactgctggggatctccacctccggtaactctgcaaacgtgatcaaagcgatcgcagcggcgcgtgagaagggaatgaaagtgatcaccctgaccggtaaagacggcggcaaaatggctggcacggcggatatcgaaattcgcgtaccgcactttggttatgccgaccgcattcaggagattcacattaaagtgatccatatcctgatccagttgattgaaaaagagatggttaagtaagtctggcgtaggccggataagacgtttacgccgcatccggcatttgtgcgctgatgcctgatgcgacgctgacgcgtcttatcatgcctacaaatctgtacgcgaaccgtaggccgaataatgcgttcacgccgcatccgacctgaaaattcttaaatcaatcttcgccgggggccatgcgctcccgctgttgtggaggttacccatgtgcgaattgctcgggatgagcgccaacgtccctaccgatatctgctttagtttcaccgggcttgtacagcgtggtggtggaaccgggccacataaagatggctggggcattaccttttacgaaggtaaaggctgtcgcacatttaaagatccacaacccagctttaattcccccatcgccaaacttgtccaggactacccgataaaatcctgttcggtggtggctcatattcgccaggctaatcggggcgaggtggcgctggaaaatactcacccatttacccgcgagttatgggggcgtaactggacttatgcccataacggacaactgacgggctacaaatcactggaaaccggcaacttccgcccggtaggcgaaaccgacagcgaaaaagccttctgctggctcctgcataaattaacgcagcgttacccgcgcacaccgggcaacatggcggcggtatttaaatatatcgcctcactggcggatgaactgcggcagaagggcgttttcaacatgctgctttcggacgggcgctatgtaatggcgtattgctcgactaatttacactggatcacccgccgcgcgccgtttggcgtggcaacgttgctggatcaggatgtggaaatcgacttcagctcgcagaccacaccgaatgatgtggtcacggtgattgcaacacagccgctgacgggcaatgaaacctggcaaaagattatgccaggcgaatggcgcttattttgcctcggggagcgtgtagtttgatgccagttgtggctgcacaacttcgtggcttaacggcttgctgaccacgtaacgaccattgaccacagaaacggttggtggcttacgggtttgctcaaagtagtcgtaacccggcttcagttgctcccagaagtccttaaagttggaatatttatggcgcttcatattggcgtcggtcatgcggaacgggtaaatactcacttgcacgctcggctgaccaaacaccagcgcaccagtaacgaactggaatatctcatcaataccctgattggtcattgcgtagcagccgatggaaacacaatcgccgtggatcatcaggtatttcccttcataaccatgcgcacggtcataggcattggggaaaccaatattaatcgctttgtagtaacggctgtctggttttaactgattacgctggacgctataaaacccttccgggcttttgaaatcgccctgacgctgttttggccctaagccgccggaatatttacagattttatagctgtcgagcagttgatattgctcgcccattttgacgtagagatcgagcgtacgttcttccttgaagatctggatgtagacaggggatcccatcaactgctgcttatactctttgctcacaggcgtggtagagctactgctgcccagcaaaccggcaaatgaaacgcacgggatcaacaacatcgcaagaattaatgcgattttacgcatactgcttattccttgataaaacggttacacacgccaggacggcaaaatggatcccaaatcggaatagtctggatttggaaggctcacattatcaccaaaagagttttacgcaagcctgtcggcgcagggtttacaaatttcatcggaagcgggctttacccaaagagcgccgcgtgagttccagttctctcaaatcgtaaaagtttatcggtaagtttgtaaatcaggatccagtccggttcgacatgagcatcgcgataacctttccatgaaccttgcagcgggtggtctttataaacagctggaagcggtaaagtattattgataagaagcgtcataagatatttcaatttattcatatccttatgacgcttttgtgcaagttttacatcctttgaatattgtcccgagtattcaatatccctttgaatcatatttaaattcctaatttatcaaataaatcatcggcgtctttggccttatgaacatcaatgccagcttcgctgtttttgattgattgaatggttaattgattaggctcgcgtaaatcaaacggcaatgccttttcacgcgcgacctttgtgagggttatgcgaaccaggtcagagatggtcagccccatcccggccagtacgtccgctgcctgattcttcagatcttcatcgattcgggcgcgaacaaacgcgttagcagccattggggtatctcctgtgctgtatatttattcagcttgaattgtagctcaaatgagcaacagcgacaatccatgagtaatttaataaacggatgtttttacataattaactgaaatatatatgttaattttataataatggtttattaagtttgttcagaaacgatccgggatacactgcaacattaaagcatgaccagccattattgagtatgtccttgccgtcgattccatcctttgtattgtcgggattactgttgatttgtttgccgttttcttcatttgccagcgccaccacatcacatatctctttcagctacgccgcccgccagcggatgcaaaaccgtgcgcgtttattaaaacagtaccaaactcatctgaaaaagcaggccagctatattgtggaaggcaatgccgaaagcaaaagggcgctacgccagcacaaccgggagcagataaaacagcatccagaatggtttcctgctccgctcaaggcgagtgacagacgctggcaggcgctggcggaaaacaaccactttttaagcagcgaccatctgcataacattaccgaagtggcgattcaccgcctggagcagcagcttggcaagccttacgtctggggcggtacgcggcctgataaaggctttgactgtagcgggttggttttttatgcctacaacaagatccttgaggctaagctcccgcgcacggccaatgagatgtaccactatcgccgggcaacgattgtggcgaacaacgacctgcgccggggagatttgctgtttttccatatccacagccgcgagatagccgatcatatgggcgtgtatttgggcgatgggcaatttatcgagtcgccacgtaccggcgaaaccattcggataagccgattagccgaacctttctggcaggaccattttttgggcgcgcgcaggattttgacggaagagacgattttgtaggacggataaggcgtttacgccgcatccggcagttgtacgcaggtgcctgatgcgacgctggcgcgtcttatcatgcctacgagcccgcgaatatttgcgagccgctttcccgatataaaacaacctcattgccaacctttccttttcttcttaccgttgagaaaaaggagtcgccatgtctgaatatcgtcgttattacatcaaggggggaacatggtttttcacggtgaatttacgaaatcgtcgaagccaacttttgaccacccagtaccagatgctccgtcacgccattattaaagttaagcgagacaggccttttgaaatcaacgcctgggtcgttttgccagagcatatgcactgtatctggacattacctgaaggcgatgatgatttttcctcgcgctggcgggaaattaaaaagcaatttacccatgcttgtggattgaaaaatatctggcaaccacgtttttgggagcacgccatccgcaataccaaagattataggcatcatgttgattatatttatataaatccagtaaagcatggttgggtaaagcaagtgagtgattggccattctcaacgttccatcgcgatgtcgcgcgagggttatatcccatcgattgggcgggggacgtaacggattttagtgccggggagcgtatcatttcataattgtgcgcagatgcctgatgcgacgctagcgcgtcttatcatgcctacaaacttgtgccggatcggtaggccggataaggcgtttatgccgcatccggcagttatgcgcagatgcctgatgcgacgctggcgcgtcttatcatgcctacaaacttgtgcctgaacggtaggacggataaggcgttcacgccgcatccggcagttgtgcaccaatgctggatacttacatcaacgcccccataatcttcaactccagctcatccggcacttcgttatacgacagcacatgcagccccggcgcaaacaaccttgcataacgcgccagcaaagggcgcagctgcggtggcaccagcagcaccgggtctttccccgccgctttcatctgctctttcacctgtggcatcgtactctggaactggttgagcatattcggatcgaccggcacgctgtcgagcatcactttcccgccctgttgcgcctgattcaccacgttggtcagcagattttccagctcattattcagcgtatacaccgtcagctcctgcttgcgaacgaacggatgggtaatgctgcgccgcaatgccaggcgcacatcggccgccagcagaatatgatctttcgtcaccgtgctactggcgaccagcacggtggcgatggtgacgatatcgcgcagggaaacgccttcggtcagcagcgcccggtacactttcagcaactggctgtaattgagcgccgcgctcaaatcttccgccagacgcggtgccgtcgacgataaacggttatgcaactgcgtaatatcatcatagttaaacaaatcaggaatatagctgcgcacaatcttatttacatgggtagcgatcacgctggcgctgtcgatcacctgataccccatattcagcgccttcgctttctgcgccgcctggatccaggtgaccggcatcccgtacgccgggtcgttcccctgcacgccgtcaatctcgccgtaggtttcgctggagggcagggccatcagtttatccgccggaatatccgcttcatcagcctttatgccgttgatgaaaatggcgtactgactgggcttaaggcggaagttttcccgaatgcggatctccggcagcagcacgccgttgccgtcagaaatcacctgccgcacgccgcgaatccgctgggtgagcgggttaccctgtgctttgtccaccagcgccaccagtttgtaaccgaggcttaaactgataggctcgatcagcggaatggtttcccaactgacctgctgctcgctggtttcggtgatggtgcgggtcagcgtttcgaggcttttctcttccgcctccgccgccagcggctgtttgctcatccgccagccggtaaaaccaagcagggcgctgaacagcaaaaacggcaggtgcggcattcccggtaccaccgccagcacgaacataatcccggtggcggtgtagagcaccgacgggcttgccagcagctggttacgcacgtcatgggcgatatcgccgttgtcgctgacgcgggtgacgataatcgccgccgcggtggagagcagcagggaagggatctgcgccaccaggccgtcgccgatggtcatcagcacatactgctggaaggcagcatcggcgctcaggttgtatttgaagatcccgatacagacgccgccgatcaggttgatcgccagaatcatcatcccggcgatggcgtccccgcgcacaaacttcgatgccccgtccatcgcgccgtagaaatcggcctcgctggcaacatctttacgccgggtttgcgcctgcgcctggttgatcaatccggcgttaagatcggcgtcaatcgccatctgtttgccgggcatcgcgtctaaggtaaagcgggcagaaacctcggaaatacgctcggcccctttggtgacgacaataaagttgattgtcaacagcgtcagtaaatccgagcgtgaaagcattatcgccgcgctgcacgggcagtcgatttttaacggtggtgggctgtcgccgttaaataaaatcagcccgtctcatccgccaaaacctgccaccgtggcggtgccggaagagacggagaaaaaagcgcgtgatgtgaatgagaaaacggcgctgctgaagaagaaatccgccaccgagcttggtgagctggcaaccagtatcaacaccattgcccgtgatgcgcatatggaagcgaatctggagatggagattgttccccagggattacgcgtgctgattaaagacgaccagaaccgcaatatgtttgaacgcggcagcgcgaagattatgccgttctttaaaacgctgctggtggagctcgcgccagtgttcgactcgctcgataataaaattattattaccgggcataccgatgcgatggcctacaaaaacaatatctacaacaactggaacctttcgggtgaccgcgcgctttcggctcgtcgggtgctggaagaggccggaatgccggaagataaagtgatgcaggtaagcgcaatggcggaccagatgctgctggattccaaaaatccgcaaagcgcgggcaaccggcgcattgagattatggtgctgaccaaaagtgcgtccgatacgctgtatcaatactttggtcagcatggggataaagtggtgcagccgctggtgcaaaagctggataagcagcaggtgctttcgcagcgaacgcgttaaatgctgaatctttacgcatttctcaaaccctgaaatcactgtatactttaccagtgttgagaggtgagcaatgcgtaaaatcattcatgtggatatggactgctttttcgccgcagtggagatgcgcgacaatcccgccctgcgcgatatccctattgctattggcggcagccgcgaacgtcggggggtgatcagcaccgccaattatcccgcgcgtaaatttggcgtacgtagcgctatgccgacagggatggcgctcaaattatgcccacatctcaccttgcttccggggcgctttgacgcctacaaagaagcctcaaatcatatccgtgaaatcttctcgcgctacacctcgcgcattgaaccgttgtcactggatgaggcttatctcgatgtcaccgatagcgtccattgccacggttctgcgaccctcatcgcccaggaaatccgccagacaatcttcaacgagctgcaactgacggcgtctgcgggcgtggcaccagtaaagtttctcgccaaaatcgcctccgacatgaataaacccaacggccagtttgtgattacgccggcagaagttccggcatttttacaaaccttaccgctggcaaaaatccccggcgtcggcaaagtctcagcggcaaaactggaagcgatggggctgcggacctgcggtgatgtacaaaagtgtgatctggtgatgctgcttaaacgctttggcaaatttggccgcattttgtgggagcgtagtcaggggattgacgaacgcgatgttaacagcgaacggttgcgaaaatccgtcggcgtggaacgcacgatggcggaagatattcatcactggtctgaatgtgaagcgattatcgagcggctgtatccggaacttgaacgccgtctggcaaaggtaaaacctgatttactgattgctcgccagggggtgaaattaaagttcgacgattttcagcaaaccacccaggagcacgtctggccgcggctgaataaagctgatctaatcgccaccgcgcgtaaaacctgggatgaacgccgcggcgggcgcggtgtgcgtctggtggggctgcatgtgacgttgcttgacccgcaaatggaaagacaactggtgctgggattatgatgtatactattatgtatattctggtgtgcattattatgagggtatcactgtatgcatcgaattctcgctgaaaaatcggtcaatatcactgagttacgtaaaaacccagctaaatactttattgatcaaccggttgcggttctttctaataatcgccccgcaggatatctcttaagtgccagcgcattcgaagcgttaatggacatgcttgctgaacaagaggagaaaaagcccataaaggcgcgcttccgtccaagtgctgcaagattagaggaaattacacgccgcgctgaacaatatcttaatgatatgacggatgatgatttcaatgactttaaggaataaggatgcgggtattcaaaacaaaacttattcgcctgcaacttacagcagaggaacttgatgcgttaacggcggattttatttcctataagcgtgacggtgttttgccagatatatttggtcgcgatgcactctacgacgactcctttacctggccattaatcaaatttgagcgagttgctcatattcatctggcaaatgagaataatccatttccgccacagttgcgccaattcagcagaacgaatgacgaagcgcatttggtatattgtcagggggcgtttgatgagcaagcatggttgctcattgccattctgaaacctgaacctcataaactggctcgagataacaaccaaatgcataaaattgggaaaatggcagaagcgtttcgcatgcgtttttgaatttatattatgaataacatacaaataagaaactatcagcctggcgattttcagcaactatgcgctattttcattagagcggttacgatgaccgccagtcagcattattcaccacaacaaatttccgcctgggcgcagattgacgaatctcgctggaaggagaaactcgcgaaatcacaagtgtgggttgcgatcattaatgcacaaccggttggttttatttcccgcattgaacattatatcgatatgttatttgttgaccctgaatacacccgccgtggggttgccagcgctttgttaaaacctttgattaagtctgaatccgaacttacggtggacgcaagcataaccgcaaaacccttttttgaacgttatggttttcagacagttaagcagcagcgcgttgaatgccggggagcgtggtttactaatttttatatgcgatataaaccgcaacattaaatccagcttgcaatgaaaataacgcccgcctggtatgtgcgcgttttctgattccacaaactgcaaggaggtaaatcatgacaaatcctttatcaatgactctttgcagacctttccaggattaattctttttttcttgccctggattcgtctgccatttcctgatttttatatttatatactctaaataattcgagttgcaggaaggcgacaagcgagtgaatcgccaggagcttacataagtaagtgactggggtgaacgaacgcagtcgcagtacatgcaacttgaagtatgacgagtataaatggaatggtacatgggcaaatatattcgtcccttatccgatgcggtatttaccatcgcatctgatgacctgtggatcgagagtttagcgatccaacaattacacaccacggcaaatttacccaacatgcagcgcgtagtggggatgccagatttacaccccggacgcggctacccgattggcgcagcgttcttctctgttggtcgtttttacccggcaagacgtcgcggtaacggtgctggaaacagaaacgggccgctactctgacacactgcgttcggcgctggtttctctcgatggcgataacgcatgggcattaagcgaaagctggtgtggcactattcagtggatttgtccgagtccgtatcggcctcatcatgggcgcaaaaactggtttctgggcattgggcgttttaccgctgatgagcaggaacaatcggatgcaatccgttatgagacgctgcgttcgtcggggccgggcggtcaacatgtcaataaaaccgactcggcggtacgcgccacgcatttggcatccggtattagcgtgaaggttcagtcagagcgtagtcagcatgctaacaagcggctggcacgattgctgattgcctggaagctggagcaacagcaacaggaaaatagcgcggcgctgaaatcgcagcggcgaatgttccatcaccagattgaacgtggcaacccgcgacggacatttacagggatggcttttatcgaaggataatgaaggatgaaactgccggaaggcgattaaacgccatccggcagcaaatcaaataattacttcgccggaatttctttcagcagttcagtcagcagtgtccagtaatgacctacgctttcgatgtgaacttgctcatccggagagtgtggaccggtgatagttggcccgatagaaaccatgtccatttccggatacggttttttgaacagaccacattccaggcccgcgtggataatctggatgttcggcgtcttgttgaacaggcgctgataggtttcacgtaccagatgcatcaccggagaattagcgtccggctgccagccaggatatgcgcctttcgcttcggttttcgcgccagccagtttacccagcgaatccagcatgctcaccacgtagtctttaccgctgtcgatcagtgaacggatcaggcagtgaatttctacgttattgtcagtcatggtcaccacaccgacgttcagggaggtttcaaccacacctttggctacatcggagttacgaatcacaccgttcggggtggcgttcagcagacgaataaaggtatcgcgagatttcgcaatcagggcagctttatcgttcgctacagagtccagcaacaaggccagatttttctctttttctgccagctcgtttttcaggatctcctgataggtattcaccagagatttcaggacgtcgactttatcagctgcgacagcaatggtcgcaaaggcttcacgcgggatggcgttacgcagtgtgccgccgttgaaatcgataaggcgcagatccagttcttccgcatgacccgccaggaagcgcaccagcagtttgttggcattacccagcccaacgtggatttccccgccggagtgaccgcctttcagaccttttaaggttaacttgaaggtttcaaaaccagctggaaccgcttcacgatctaaatgcaggttggaggtgaagtcgataccccccgcacaacccatgtagatttcaccttcttcttcggagtcggtgttaatcagaatatcagcctgcaaccagttgccctgtaagccgaacgcaccgtccataccggcttcttcggtcatggtcagcagcacttccagcgggccgtgaaccacgttttcgtcagccagaaccgccagcgcagaggccataccaatgccgttatccgcacccagcgtggtgccgcgcgctttaacccattcgccatcaatataaggctggataggatctttcgtgaagtcatgcacggtgtcgttatttttctgcggcaccatatcgaggtgggcctgtaagacgaccggtttacgattttccatacctgcggtagcaggtttacgaatcaggatattacctacctgatcgcgttcgacatggaaacctttctcttttgcccaaccaacaatgtattcagcgagttgctcttcatgataggacgggtgaggaatagaacagattttggcaaaaatatcccacagcggctgtggagataattgagacagttcagacacgttaagtctccttgtcgatcacccgcaaaacagtattgcaggtcacagggttagcagaaaatgttgtcaacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccacccaggcgatggtgtggcaacaaaaagcctgtgcggaagacgatccgcaactcagtggtcgtcactggctgcatgcggctacgttgtacaacattgccgcctatcctcatctgaaaggagatgacctggccgagcaagcgcaggctttgtcaaaccgcgcctatgaagaggccgctcagcgtctaccgggcacgatgcggcagatggagtttaccgtacccggcggtgcgcccatcaccggctttttgcatatgccgaaaggcgatggcccgttcccgacggtattaatgtgtggtggtctggatgcgatgcagacggactattacagcctgtatgaacgttattttgcgccgcgcggcattgcgatgctgactattgatatgccgtcggtgggcttttcttcaaaatggaagctcacccaggactccagcctgttgcatcagcacgtcttaaaggcgctgcctaacgtaccgtgggtggatcacactcgcgtcgcggcctttggtttccgtttcggcgctaacgttgccgtgcgtctggcataccttgaatcgccgcgtctgaaagcggttgcctgtcttggtccggtagttcataccctgttgagtgattttaagtgccagcaacaggtgccggaaatgtatcttgacgttctggccagtcgtttggggatgcatgatgcttccgatgaagcgttgcgcgtggagctgaatcgctattcattaaaagtgcaaggattgctgggacgtcgctgcccaacgccaatgttatcaggctactggaagaacgatccgttcagcccggaagaggactcacgcttaatcacctcatcatctgctgacggtaaattattagagatcccatttaacccggtgtatcggaattttgacaaaggtcttcaggaaatcaccgactggatcgaaaaacgcttgtgttaaaaatttgctaaattttgccaatttggtaaaacagttgcatcacaacaggagatagcaatgacgttaccgagtggacacccgaagagcagattgatcaaaaaatttaccgcactaggcccgtatattcgtgaaggtaagtgcaaagataatcgattctttttcgattgtctggctgtatgcgtcaacgtgaaaccggcaccggaagtgcgtgaattctggggctggtggatggagctggaagcgcaggaatcccgttttacctacagttaccagtttggtctgttcgataaagcaggcgactggaagagtgttccggtaaaagacactgaagtggttgaacgactggagcacaccctgcgtgagtttcacgagaagctgcgtgaactgctgacgacgctgaatctgaagctggaaccggcggatgattttcgtgacgagccggtgaagttaacggcgtgagtgaaatgtgccggatgcatcacatccggcaatattcattaaaactgatacgtcatgccaaccgcgacaatatcatcattattaatattcaatttgttatcgctatccagttggttgattttataatcaacaaacgctgacatatttttgttgaaataatacgtagcaccgacgtcgatataattgaccagatcttcatcaccgataccttcaatatctttccctttcgataagacataacccagcgatggacgcagaccaaagtcaaactggtattgagcgaccgcttcaaagttctgtgtcttattggcaaagccgccagttattggcgtcattttgcgtgtttcagaatagaaagttgccagataaatattattggcatcgtatttcagacctgttgcccatgcttctgcacgcttgcctgtgccacggctttgcaggttctgctcgttggtgcgatctgagttggtataggccccactaatggcgaaatcgctgccgccaaagtcatatgtcaatgacgtgccgaagccatcgccgttttgctttttaacgtcgcggttttcgtttttcccttgatattgcagggttaagttcaggccatcgataacgccgaagaagtcggtgttccgatacgtcgccagaccgctggcgcgtttggtcataaagttgtcggtctgcgccgaggaatcgccaccaaattccgggaacatatcggtccaggcttccacgtcatacaacgcccccaggttacgaccataatcgaaagaacccaaatctttatatttcaacccggcaaaagcgagacgcgttttttgctgtgcagtatcactctctgctttattaccggcaaactctgcttcccaacgaccataaccagtcagttgatcgttaatttgtgtttcgcctttgaaaccaaaacggatataactctggtcgccatctttactggcgttatcactcatataatgcatggctttaactttgccatagacatccagtttattaccgtctttattatatatttctgcagcctgtacagatgcagatgccacaatgcccatcaccactaatgccagagtgctctttttcattttcattcctgattttaattaacgcgcgaatattcagcgggagagtcccgttgaaaacaggaaagtttttaacctgagattgttaaagatatattacagattaataatattcttaaaatgtggtaatttattaaatctgtaataaaagcgtaaacaactgccgctaggcttgctgatcccgcgcaacaaaacgccatgctttgctcgcagatggttggcaaccgacgacagtcctgctaaaacgttcgtttgatatcatttttcctaaaattgaatggcagagaatcatgagtgacagccagacgctggtggtaaaactcggcaccagtgtgctaacaggcggatcgcgccgtctgaaccgtgcccatatcgttgaacttgttcgccagtgcgcgcagttacatgccgccgggcatcggattgttattgtgacgtcgggcgcgatcgccgccggacgtgagcacctgggttacccggaactgccagcgaccatcgcctcgaaacaactgctggcggcggtagggcagagtcgactgattcaactgtgggaacagctgttttcgatttatggcattcacgtcgggcaaatgctgctgacccgtgctgatatggaagaccgtgaacgcttcctgaacgcccgcgacaccctgcgagcgttgctcgataacaatatcgttccggtaatcaatgagaacgatgctgtcgctacggcagagattaaggtcggcgataacgataacctttctgcgctggcggcgattcttgcgggtgccgataaactgttgctgctgaccgatcaaaaaggtttgtataccgctgacccgcgcagcaatccgcaggcagaactgattaaagatgtttacggcattgatgacgcactgcgcgcgattgccggtgacagcgtttcaggcctcggaactggcggcatgagtaccaaattgcaggccgctgacgtggcttgccgtgcgggtatcgacaccattattgccgcgggcagcaagccgggcgttattggtgatgtgatggaaggcatttccgtcggtacgctgttccatgcccaggcgactccgcttgaaaaccgtaaacgctggattttcggtgcgccgccggcgggtgaaatcacggtagatgaaggggcaactgccgccattctggaacgcggcagctccctgttgccgaaaggcattaaaagcgtgactggcaatttctcgcgtggtgaagtcatccgcatttgcaacctcgaaggccgcgatatcgcccacggcgtcagtcgttacaacagcgatgcattacgccgtattgccggacaccactcgcaagaaattgatgcaatactgggatatgaatacggcccggttgccgttcaccgtgatgacatgattacccgttaaggagcaggctgatgctggaacaaatgggcattgccgcgaagcaagcctcgtataaattagcgcaactctccagccgcgaaaaaaatcgcgtgctggaaaaaatcgccgatgaactggaagcacaaagcgaaatcatcctcaacgctaacgcccaggatgttgctgacgcgcgagccaatggccttagcgaagcgatgcttgaccgtctggcactgacgcccgcacggctgaaaggcattgccgacgatgtacgtcaggtgtgcaacctcgccgatccggtggggcaggtaatcgatggcggcgtactggacagcggcctgcgtcttgagcgtcgtcgcgtaccgctgggggttattggcgtgatttatgaagcgcgcccgaacgtgacggttgatgtcgcttcgctgtgcctgaaaaccggtaatgcggtgatcctgcgcggtggcaaagaaacgtgtcgcactaacgctgcaacggtggcggtgattcaggacgccctgaaatcctgcggcttaccggcgggtgccgtgcaggcgattgataatcctgaccgtgcgctggtcagtgaaatgctgcgtatggataaatacatcgacatgctgatcccgcgtggtggcgctggtttgcataaactgtgccgtgaacagtcgacaatcccggtgatcacaggtggtataggcgtatgccatatttacgttgatgaaagtgtagagatcgctgaagcattaaaagtgatcgtcaacgcgaaaactcagcgtccgagcacatgtaatacggttgaaacgttgctggtgaataaaaacatcgccgatagcttcctgcccgcattaagcaaacaaatggcggaaagcggcgtgacattacacgcagatgcagctgcactggcgcagttgcaggcaggccctgcgaaggtggttgctgttaaagccgaagagtatgacgatgagtttctgtcattagatttgaacgtcaaaatcgtcagcgatcttgacgatgccatcgcccatattcgtgaacacggcacacaacactccgatgcgatcctgacccgcgatatgcgcaacgcccagcgttttgttaacgaagtggattcgtccgctgtttacgttaacgcctctacgcgttttaccgacggcggccagtttggtctgggtgcggaagtggcggtaagcacacaaaaactccacgcgcgtggcccaatggggctggaagcactgaccacttacaagtggatcggcattggtgattacaccattcgtgcgtaaataaaaccgggtgatgcaaaagtagccatttgattcacaaggccattgacgcatcgcccggttagttttaaccttgtccaccgtgattcacgttcgtgaacatgtcctttcagggccgatatagctcagttggtagagcagcgcattcgtaatgcgaaggtcgtaggttcgactcctattatcggcaccattaaaatcaaattgttacgtaagatcttatcattctcccaccaaaaaattatcttaatgtaacagctggtgtaagtaaattctatcaacgaagatcaatcttatctactgaccaaaaaggcctgatagggcttcgctcactatacatccttggctgcaggtttagttgtacaccactcctaaatttaatgtgttggcaatgtgttcaataaagctcgaacaaattagctcattatgatcggttaatacttcaacttctggttgcatgattgtttgtccgtaaaaagataacgcgcctgccgggtagtagcaggcgcattacgcaataggtaaacaagggaggaagttcagaaatgtaaatcgggaaggttgtacgcaatgttcatcgtactacgttgttacggctttgccgcaacaagccagttgcctgccgcgctcgcagaatgtctgcagcccggagataaggagattgttcctgccagctaaatcccttcctgtcgatacgaaccagctcgtatttttctaccagaaaattcacggcatcggctagggtgataccggcatcgatgtgttccttaatcacagcctcattgcagaatggcgtgtcgtttattgtcagaccatagtgctgttccagcagacgtgtcagtaacatttgccagacagccacgggtgacaggcagggcttcaccgcccgctgagttattgcaggtaaagttttcatgtttgctctcgtgtaggtaattaacgctgagtggggtaaatggcgatgtatacgtagccgcaactgccaagggtgtcggcttcgcaggttaaatcgttgtggtacagggtaacgcagtgggcatggtgggggctgagttcaccggtggtcagcatcgattccatctggaggataaagtgcgggaatgtttcatccagcttccggcattcgatgtcactgaacttgccggtgatgctggcccggtcagccagataatgcagtcggttgccttcctgcaccagacgggctcccaggcgcagtgtaatctcccgctgcaggcccctggtagggttgctcattacagttctccactattgtcagttcagggtgatgctcatcaggcaggtatagggcccattgcggtcctggcggcgttcggcgtataccgcgaggactccggcgatatccggaacgtccctgccggtgtaatgacagacgctaccgtgccactggtatttgccggtgcagtagcgaaagattcgggactcaggatgctggcggtatatcgtcattgccctgcgtttactgataattttcatgtaatacctcaaagcagaccgtgttctgcgaacgaatagatttgcctgccaccgacaatcagatggtcagggacacggatatccaccagctgaagcacctgaaccagtcgctgcgtgagggttttgtcggcctggctaggtgtcgtctcgccggaaggatggttatgcgcgagtatcaccgccgccgcgttgaagtgcagagcacgtttgaccacctcccggggatgcacctcggtgcggttaatcgtgccggtgaagagcgtttcatgggcaatcaactgattctggttgtccagatacaacacccggaactcttcccgctcaagcgcggccatatgcagtcgcagccattcacgtacggcgtgggtagaggtgaaggctacgccgggctcatgcaggtggcggtccagagccctgagcgcccgctgaatgagacgccggtcctgtggcgtcatctcgccgggtaaaaaggaaagctgtttcatctgttgctccttcggtcagtcgataatacgcagaatggcgtgagcctctggatgttgcatggcatactcccgcaggcggtaatagtgtgcggtcatcgcgtcacattctgtacggcaggcatggtggctatacgcaatcaggcagacagcaatacctgctgcttctgcactcatttgggcatcgttaccgttcaggcagttaaacagacgccatgtctcatcgttgtcaggctcgggggacataaatgcgccgccattgctgagggtgtagaacgaccagataccaccgctgtagccctcacagaagcggtccatccaggcgaagatatgcggctccaggagtagccactgcgggatagcgccaaagtactgtggccagaaatcgatacgctgttcatcggggaccggcgtgacggtcagttcaaattcgggttggttagcgggtgcgaggtcgtgctgcgtctgtgttgtcatgggtatgtctccgtcaataaaaacgccagcggcgatggctggcgtatggggatataaagtgtgttcggggaggtgaatgcgggtaaatgcttcgcgatcagcgggtggccgtgtctgtacggatgcctgaggtgcggatatagcggttaagaccttcaccggcatccggctcaaagttccatgcccgccagaccatccggccttcagtatcacgaaccaccagacggaagtgactgccctggtcgtcttcgagtgtgatattgctgtacgtggtagtgaccgcttgcgcttgtctccgggtgaaaggccccggtggcagcaacacggattgggtcattttcgggctcctgataaaagaaaaccccggcagcctgctagctgtcggggtgaatttgctggggaagatactactatcagtcgttgctgcagtctccgagagtggacagaactttctcagcgttcttccggtccgcagtgaaggtccctgctttgtggtcattgacgtagacgtcgaactgcccggcctcagagatattgctgatgaagtcaaaccaggcgttatcgccgttacgccagcccaggctggacggaataatgtactgctggtgatccatcactacggtgatagtagtgtcgtcatcgtgcgaactgaccatcttgtcatcggcaagggtaagaaagactgaatgctgatagaaaccattctggtccgggttccctgtgcagttgatggtaaacgtctttccgctggcttcggtcacgctgtattccgtattgccctgaccgtaaccctgctgccagaaccccgggatagcagaggcattaaagctcgcgagcagtacacccgccagcataaaccgacttagtgaaagtattgtcattcttgtctcctttgtcgttgttttattcctgattgtcagggttcgagggtatcagtagctgccccatcagtttgccgtcatgggcgtactcaaagtatttttctttggtatacgggtccgtcacctcctggtattccagtttgatgttatcggcaatacacagcgcattcatcagtggctggacggttttttcctgcatatccacgaggtagtagtaactgccatcctcgcagccatcgggcgactggcgggtacgtaaaacctgcaaggtgggaccggataagtagtcaacctgtgaccattcttcgctgacatcatcctggtggctgaccacatcactgaaacgcggtggggtgaggtccttaaatttactgatggccttcaggtcatcacttctgtcatcgcatgcgatgagaaacagagtggtggcaaccagcgccagcagaggcagtgttttacgtttcattatttttttcctgaaatcagacgaaccactttggcaaagacataaatgcccacgaaaatacccaccggcacgccgacgaacggtgtcagcgcgacactggcagcaccggctgcgccacctcccgtcagcagtgcggcaacagtggcaagggtcagggccgcgagactgtcggacaccccggttttgttcagaatgatgacgatgacaacaatggcgataatggcaatatccggactgatactccaggtccagatacatcagccgctcacgaaaatcacgccgcagcgtgcgcaccgacacaccaaactcagcggcaagcttacgcacactcagcgtttcccctgccaccagacggctgattatcagtgacagcctgacagccagccggtcatggcggcgttctgcctgtgtcatgagacgttctccgtgaaagttaactgactgaaaatgatgtgattactttaaagagggggtcggacagggtatggacaccacagaaactatttttcatttctgcaaaagccagaggcagcgggggttacaggccttccctcggtgagtgaggaccgtcagcacggtgcgatgcggacaggtggtgtccgatattaacaaagcagcaacattaaacggtcactgcagttgcgtgagcagggcttccgccatcacccacagtgcccggttaagtttcacgtccccgtcgataccgcgaacggcacgggtatgtgaccgtcctcctttggcattacggccactgagcccgcccttaatcaggttctcctgaatacgctggtacgtggtccacaggtcattgctctcatcctgccagcggcgaggggagaggatctgcgattcagtcaccggctggtggtcttcaccaaagcggtatgtgagggcggcttttgccagtgcctgctgtgccgggggtggcaacagcaacgactgcatggcatcccgtttctcctccacccggtcaaaaatccccagcacctcatacgcgccttcaatcacctgactcaccacgtcccccttgtgtggcacccgcacctcgccaaacgactcaccgcagacgagcccgttctgacaaaccgcacgaaatagtcccggcaacatctgatacgaactggttccatcgtgagagttgagtagaataatttccggcacctgtttaccggtgatctgcccttcccgccgcagacgcagcatatgctttgtatgttcacgacgacccgggtcacgcacgcgggtctgacaggcaaagaatggctggaagccttctcgctgtaggctgtcgagcagggagatggtgggtatataggtataacgctcactacgggactcgtgtttgtcctcactgaatacactgggcactacgcgaaacagctcttcacgggttaacggacggtcgcgacggataaggtttgctgcgccaaagcgcgaagccagacgggtcataagcagactcctcataacgggaaaacaaataaaagggatccccgtcgcatcggcgacaggggcagggaagtaacagggatgggttaaatactcagaagaagaaatcccagacggcgcgggccactgacaccaccgtggtgcgcacggcctgaatgacggcccgcaccggggcgggtatcaggggaaaggcactgatgctatcgagtacggccccgacggtttcaccaaaatcgctacgagcctgttcccggactaccgtcgtgcgaaaggaaggatggagttgcgacaccaccgggctggtggcctcacgtggcaggcacttaatcatccgctcggccatcaccttaagcccccattgtagacggaccgacacagcacacaccggatggacgggctggaacagctcatgcagcaggcagattttgcggctgatattctgcttctgcgccgtggacaactgtcccccaccgctggtaggttcggccttatccgactggctgataacaaacagcaccttatgccggtatacctctccaatcacctgatgataaaaatgttcatccaccgtcagcgcccggtcatcggccttaatcagccacagtaccaggtcgaggcgaggaagctgttcgcggtacagcgcagcatactcggtatcgcgagcgccactttcgcccacgccgggcagatccatcagcgttatatagcggtcgccgacttgcaggcgaaagcgcagtggctcacgtgtacaggccgccacatcgctgaccggtgatatatctccggcaaacagggcattgcacagactgctcttcccaacaccggttttacccataatgccgatcactggctcgtagttagttaactggttaatttgctgcagaagccgctctgatacccattgcggcagatcagcaagcgattgctgaaacgacttcaaaccttcagaattattcatcactactcctctgaaaaataataaaaaacggtagaatcgtgagattccgccgttaattgcgtatgttcagagtgatgatatatatctgaagattttttcaatcctctgcgcttgaggcagctgcgcgactgctggctcaggcaatgaatgagttataatagcagcatttactaacagggatttattgagagtatgagccgccgtgatacaccttaaaatctcaacccagcaaagtttcggagccgcgagcaaaagtgagagccttcacaaaataatgcttagtaataaagttactttgaattcagagccccgattaatgtgaacatgatcaacgaattttacccagattgagttcattcagtagccaggttttgaacacatcaagcgcagaatgcatgtgttggtgctgggggaaaaccaaataatgaccgatgtaatgtatttcgctggtactgtttacaagtgggcataccagtttaccgctagcgatttcacgttcagccagtagttttgattcaagcacaactcccaagccgtcaactgcggcagcaatcgccataaagctacggtcaaatcgaaggccataattattgggtggcgtcatcttattcgcctcaaaccatcctttccactggtacaactgcacatcgcactgaatcaatgtcaacgcatagagatcctctggtttctttagccgctcagccagttggggagaacacagtggcgtaagttcttcaacagcaagcgggatcttctcatagggtgatgggcggggttcaccgtagactatatcgagatcaaaatcatcctgttcaaaacgtgcatattctgtgctggctgaaagtcgcagatcgatgcttgggttctcacgtatgaacttaccaagacgtggtaaaagccattgatgggcaaaactcggtgcagtatgaaggcgcaaaggcctggattcatcagccgtcactaatgccaacccctgctgtaattcgttaaatccccgctgtatgtgctcaagcagtatttcaccttctttcgtcagcgtaatttctcgcgtactgcgctgaaaaaggcgtacatcaagcaagttttccagtttgcggatggcatggctgatcgcactgggtgacagttccaactcagaggcggccaacgcaaaagctccggtacgaccagccgcttcaaaggcgcgtaacagatttagaggtgcttttgctaagagcttcattcatgaatccttttcactagggatgaagtggtttactgaatttggccacctgaacagaggtgatatgctcacctcagaacaacacaggtgtcataatgaaaaaaagaaatttcagcgcagagtttaaacgcgaatccgctcaactggtcgttgaccagaactacaccgtggcagatgcagccagcgctatggatgtcggcctttccacaatgacgcgatgggtgaaacaattacgtgatgaacggcagggcaaaacaccaaaagcctcccccattaccccggaacaaattgaaatccgtgagctcaggaaaaagctacaacgtattgaaatggaaaatgaaatattaaaaaaggctactgtagattcaattggtcaacgcaacagttatgtgaaaacatggggttgcggaggttttttgaatgagacgaacatttacagcagaggaaaaagcctctgtttttgaactatggaagaacggaacaggcttcagtgaaatagcgaatatcctgggttcaaaacccggaacgatcttcactatgttaagggatactggcggcataaaaccccatgagcgtaagcgggctgtagctcacctgacactgtctgagcgcgaggagatacgagctggtttgtcagccaaaatgagcattcgtgcgatagctactgcgctgaatcgcagtccttcgacgatctcacgtgaagttcagcgtaatcggggcagacgctattacaaagctgttgatgctaataaccgagccaacagaatggcgaaaaggccaaaaccgtgcttactggatcaaaatttaccattgcgaaagcttgttctggaaaagctggagatgaaatggtctccagagcaaatatcaggatggttaaggcgaacaaaaccacgtcaaaaaacgctgcgaatatcacctgagacaatttataaaacgctgtactttcgtagccgtgaagcgctacaccacctgaatatacagcatctgcgacggtcgcatagccttcgccatggcaggcgtcatacccgcaaaggcgaaagaggtacgattaacatagtgaacggaacaccaattcacgaacgttcccgaaatatcgataacagacgctctctggggcattgggagggcgatttagtctcaggtacaaaaaactctcatatagccacacttgtagaccgaaaatcacgttatacgatcatcgttagactcaggggcaaagattctgtctcagtaaatcaggctcttaccgacaaattcctgagtttaccgtcagaactcagaaaatcactgacatgggacagaggaatggaactggccagacatctagaatttactgtcagcaccggcgttaaagtttacttctgcgatcctcagagtccttggcagcggggaacaaatgagaatacaaatgggctaattcggcagtactttcctaaaaagacatgtcttgcccaatatactcaacatgaactagatctggttgctgctcagctaaacaacagaccgagaaagacactgaagttcaaaacaccgaaagagataattgaaaggggtgttgcattgacagattgaatctacaaccgcgctcttgatgtcagactccctgaacagttctcgataatcgggaaactcagggcgcgttatcctgtggccactctctgccatgtgttcggggttcatcgcagcagctacaaatactggaaaaaccgtcctgaaaagccagacggcagacgggctgtattacgcagtcaggtacttgaactgcatggcatcagccacggctctgccggagcaagaagcatcgccacaatggcaacccagagaggataccagatggggcgctggcttgctggcagactcatgaaagagctggggctggtcagttgccagcagccgactcaccggtataagcgtggcggtcatgagcacgttgctatcccgaatcatcttgagcgacagttcgccgtaacggaaccaaatcaggtgtggtgcggtgatgtgacctatagtgtgcccggagttcagggcgggcatggatgcttaaatgaaccgcgagtctgtctggaatattgaaccggtaactcacgatgagaaacccaacaatcccaccgggtgtgacggtggagaacctgagcggcagtgacctgcggcatgcccgcagggtgatgtaacccgctgacaacggggattgaggcgagatcactaagccgagatgatcctcaaggttaagtactgaaaggttgaagaacatgaacccgttaatccgcctctgtgggttgaaaacgtcaccacggcctacgtgatctgacaggccgtgcaggaggaactggcagtgatacgtaagcactgccggtcgaaggtgttttgacatgtatgcgaaacaccggggcagcagcgtctatcacgcttgcgttgctgacttctgccaacttgcggcaagcaaggataaagagtgcgacgggcagcctcctcagtatgcctgagtccaggcaggtaaaccggggaaggtcagcgacggatgttaagggggcatggctccgatgacgcgctggctggcggagcttccgtagtagtccgcgatggggaaagcccattacatggcgaagggaagcagtttgaatgtgtttgcgacgtgaattaactgacctaacgaggtgaagacctttgataatcagcgaaatgcaacgcaagcttgccacatgggcagccaccgatccgtccctacggattcaacggctgctgcgtctgataacacaaccagaatggctggctgaagcggcgcggatcacgctttcatcaaagggggcccatacccccggcgttgatggcgtgaacaaaacaatgctacaggccagactggctgttgagctgcaaatcctcagggatgaattactctcaggccactaccagcccttgcccgccagacgggtttacatccctaaaagcaacggcaaactgcgaccactgggtatccccgcgttgcgggatcgtattgttcagcgggccatgctgatggcgatggagccgatatgggagagtgattttcatacgctctcatatggcttccggcctgagcgcagtgtccaccacgcgatccgcacggtgaaattacagctcacagactgtggtgaaacccggggacgctgggtgattgaaggcgacctgtccagttacttcgacaccgtacatcatcgactgctgatgaaggctgtacgccgcaggatcagtgacgcacgtttcatgactctgctgtggaaaaccatcaaggcgggacatatcgatgtcggtctctttcgggcggccagtgaaggtgtgccacagggcggtgttatatcgccgctattatcgaacatcatgctgaatgagttcgatcaatacctgcatgagcgctacctgagcgggaaagccagaaaagatcggtggtactggaataacagtatccaacggggccgaagtacggcggtcagagaaaactggcagtggaaacccgcggtggcgtactgccgctatgccgatgattttgtcctcatcgtcaaaggcaccaaagcacaggtggaagccatcagggaggagtgtcggggtgtgctcgaaggcagtctgaaactcaggctgaacatggataagactaaaatcccccatgttaatgacggctttatctttctggggcacaggctcattcgcaaacgcagtcgttatggcgagatgcgagtggtctcaacgatcccgcaggagaaagccagaaacttcgccgcatcgctgacagcactgttatggaaggtgcgaataagcggggaaattcttctcggctgactcagtcatttcatttcttcatgtttgagccgattttttctcccgtaaatgccttgaatcagcctatttagaccgtttcttcgccatttaaggcgttatccccagtttttagtgagatctctcccactgacgtatcatttggtccgcccgaaacaggttggccagcgtgaataacatcgccagttggttatcgtttttcagcaaccccttgtatctggctttcacgaagccgaactgtcgcttgatgatgcgaaatgggtgctccaccctggcccggatgctggctttcatgtattcgatgttgatggccgttttgttcttgcgtggatgctgtttcaaggttcttaccttgccggggcgctcggcgatcagccagtccacatccacctcggccagctcctcgcgctgtggcgccccttggtagccggcatcggctgagacaaattgctcctctccatgcagcagattacccagctgattgaggtcatgctcgttggccgcggtggtgaccaggctgtgggtcaggccactcttggcatcgacaccaatgtgggccttcatgccaaagtgccactgattgcctttcttggtctgatgcatctccggatcgcgttgctgctctttgttcttggtcgagctgggtgcctcaatgatggtggcatcgaccaaggtgccttgagtcatcatgacgcctgcttcggccagccagcgattgatggtcttgaacaattggcgggccagttgatgctgctccagcaggtggcggaaattcatgatggtggtgcggtccggcaaggcgctatccagggataaccgggcaaacagacgcatggaggcgatttcgtacagagcatcttccatcgcgccatcgctcaggttgtaccaatgctgcatgcagtgaatgcgtagcatggtttccagcggataaggtcgccggccattaccagccttggggtaaaacggctcgatgacttccaccatgttttgccatggcagaatctgctccatgcgggacaagaaaatctcttttctggtctgacggcgcttactgctgaattcactgtcggcgaaggtaagttgatgactcatgatgaaccctgttctatggctccagatgacaaacatgatctcatatcagggacttgttcgcaccttccggaggcgttatgagctggcggccctttttgtatctgattattaatccccacccgctattaagcgcccggcgcgggcatctgcgtctggtgcagggttgactttgcattctgttaacaaacgcggtataacaaaccttctttggatgtttagatgtccatacgtttagaaggttatatgcaaacaacacaacaaaatgcgccactgaagcgcacaatgaaaacgcgtcacctgattatgctttccttgggcggcgtgattggcacaggattattcttcaataccgggtacatcatttccaccactggagcggcgggaacgctgctggcctatctgattggtgcgctggtggtctggctggttatgcagtgtctgggcgagctgtcggtcgcgatgccggagaccggagcgtttcacgtttatgccgcgcgctatcttggtccggctaccgggtataccgtggcctggctttactggctgacctggaccgtggcgctgggttcgagctttaccgccgctggattctgtatgcagtactggtttccacaggtgccggtatgggtctggtgcgtggtgttctgcgcgattatttttggtctgaatgttatctccacgcgcttttttgccgaaggggagttctggttctcgctggtcaaagtggtcactatcatcgcctttatcatcctcggtggggcggcgattttcggctttattccgatgcaggatggctcgcccgcgccggggctgagtaatatcacggcagaaggctggttcccgcacggtggcttaccgattttgatgactatggtggcagtgaactttgctttttcgggtaccgagcttatcggcattgccgccggtgaaacggaaaacccgcgcaaagttatcccggtagcgattcgtactaccatcgcgcgactgattattttctttatcggcaccgtgtttgtgctggcagcgctgatcccgatgcagcaggtgggcgtggagaaaagcccgtttgtgctggtatttgagaaagtagggatcccgtacgccgctgatatttttaacttcgtgatcctgacggctattctttctgcagcgaactccgggttatatgcctccgggcgcatgctgtggtcgttgtcgaatgaacgtacgctaccggcctgttttgcgcgagtaacgaaaaacggcgtgccactgacggcgctgtcggtcagtatgctcggtggtgtgctggcgctgttttccagcgtggtggccccggacacggtatttgttgcgctgtcggcaatctccgggtttgcggtggtagcggtgtggctgagtatctgcgcctcgcattttgtttttcgtcgccgtcatctgcaacaaggtaaggcattgagtgaattacattatcgcgcgccgtggtatccgctggtgccagtattaggttttgtgctgtgcctggtggcctgtgttgggctggcattcgatccagcgcagagaattgcgttgtggtgcgggttaccgtttgttgcgttgtgctatggtgcttatttccttactcaaccccgaaacgcaaaacaggagccagaacatgtcgcagaataatccgttacgcgctcttcttgataaacaggatatcctgctgctggatggcgcgatggcgacggagctggaagcgcgagggtgtaacttagccgacagcctgtggtcagccaaagtgctggtagaaaacccggagcttatccgcgaagtgcatcttgattactaccgggcgggggcgcaatgcgcgatcactgccagctatcaggcgacgccggcgggcttcgccgcgcgaggtctggatgaagcgcagtcgaaagcgctgattggcaaaagcgtggagctggcgcgtaaagcccgtgaagcgtatctggcagagaacccgcaggcgggaacgcttctggtggcgggatccgtcgggccttacggcgcgtatctggcggatggctctgaataccgtggcgattatcattgtagcgttgaggcatttcaggcgtttcatcgcccgcgcgtggaagccttgctggatgccggggccgatctgctggcctgcgaaaccctgccgaatttttccgagattgaggcgttggccgagctgttgaccgcatatccgcgtgcgcgggcgtggttctcatttaccctgcgcgacagcgaacacctgagcgacggtacgccgctgcgtgacgtggttgcgttgctggcgggttatccgcaggtggtggcgctaggcattaactgtattgcgctggaaaacaccaccgctgcgttgcagcatttacacggtttaacggtgctgccgctggtggtgtatccgaactcgggcgagcattacgatgccgtgagcaaaacctggcatcatcacggtgaacattgcgcgcagctggcggattatctgccgcagtggcaggccgctggcgcacggttgattggcgggtgctgtcgcaccacgcctgcggatatcgccgcgttaaaagcgcgaagctgagggtttatcgggtctacatcgttcattgtaggcctgataagcgcagcgcatcaggcattgccggatggcggcacaagcgccttatccggcctacaaaaccacaaaacgttatgccgcatccgccagaacaaacatgccgtacggatggatttcaagataatactgctcgccgacgtccggttgcagacgcgtagcgttgacctgcaataatatctcctgcccgtgccattccaccgtcacttcatactgcggccccatataggcgacatggcggatcacgcagcgctggctctcttcgccgcgatcgctgagcgtgatcgcttccgggcgcacaccgaccatcccttcaccctgtgtaccaaagtgcagcgggcgcggcagatgatagccgtagatatcaacgtatccgtcgctgaaggttgccgggaacaggttggcatcgcccataaagctcgccataaagcgggaggcgggctggcggtaaagatcctgcggtgagccgatctgcatgatgtgtcccttgttcatcaccagcacagtatcagaaaccgcaaaggcttcgctctgatcgtgggtgacgtacagcgaggtgatatcaaactgcttttgcaactcgcggatcttgtcgcgcatgctgcgacgcaggttggcgtcgaggttactcaacggctcatcaaacagcagcactttcggcttgaggatcagcgcgcgggccagcgccacgcgctgctgctgcccgccggagatctgatcgacaaagcggtcttcgaatccttccagatccaccatcgccaacgcctctttgacgcgggctttcagctctgcgcgcggtacgccgagcattttcaggccataaccgacattctctcccagcgacatatgcgggaacagggcataggactgaaacaccatacagatatcgcgctgctgaatagagcgatgggtgacgtcttcgccatcaatgaaaatttgcccttcgctcggtttttccagcccggcaaccaggcgcaaaatagtggttttgccgcagccggacgggccgagcagcgtcaccatttgcccctgcgggatggtgaggttgatattgtcgattaccgtattactgccaaatcgtttagtgacgttgcgcagttcaacgaaatttttctgagtcatagtgcgctccattacgcctggtttttggcttttgaacgggaggtacgtgattcaccgatcagccagtcaaagatgaaaataatcgccagcatcaccacgatcagaatggaaccgtaggcaatcgctacaccgtattcgccatcttccacgcggttgaggatgtaagccgtcgctacgcgggtatccggcgtgacgaggaacacaatggcgctgacggtggtaatggcgcgcacaaagctgtaaatcagcgccgagaggatcgccgggcgcagcagcggcagcaggatgtgcgtaatggtacgcagggaaccggcgcgcaggctgagtgaggcttcatcgagcgatttatcgatttggcccggtaatgactccaacttattgatagtgttttatgttcagataatgcccgatgactttgtcatgctgctccaccgattttgagaacgacagcgacttccgtcccagccgtgccaggtgctgcctcagattcaggttatgccgctcaattcgctgcgtatatcgcttgctgattacgtgcagctttcccttcaggcgggattcatacagcggccagccatccgtcatccatatcaccacgtcaaagggtgacagcaggctcataagacgccccagcgtcgccatagtgcgttcaccgaatacgtgcgcaacaaccgtcttccggagcctgtcatacgcgtaaaacagccagcgctggcgcgatttagccccgacgtatccccactgttcgtccatttccgcgcagacgatgacgtcactgcccggctgtatgcgcgaggttaccgactgcggcctgagttttttaaatggcggaaaatcgtgttgaggccaacgcccataatgcgggcggttgcccggcatccaacgccattcatggccatatcaatgattttctggtgcgtaccgggttgagaagcggtgtaagtgaactgcagttgccatgttttacggcagtgagagcagagatagcgctgatgtccggcagtgcttttgccgttacgcaccaccccgtcagtagctgaacaggagggacagctgatagaaacagaagccactggagcacctcaaaaacaccatcatacactaaatcagtaagttggcagcatcaccgagaacacaaatgggctaattcggcagtactttcctaaaaagacatgtcttgcccaatatactcaacatgaactagatctggttgctgctcagctaaacaacagaccgagaaagacactgaagttcaaaacaccgaaagagataattgaaaggggtgttgcattgacagattgaatctacagcagctttttttaatatgtcccgttcgtcggtaacccgtttcagctctttctggagacggcggatctcggcctgagcatctgactgttctttattagtggaagaatccggaccgtacttctttatccaggcataaaggctgtgggtggtgatatcgagacgtgttgcaacgctggcaacagaataaccgagatcaacaacctgtttgactgcttcagttttaaactcttcgggataacgcttaccgctcatgggcacctctctttaagccattttaaatgactcggaggtgtctgttaaacccgtggcgattcaaaattgcgatatatacatacccatgactgcccagcgtatcggcttcaccagtcagcccgttacggtacagtgtgacacagtgcgcgtacctgggattcagctcacaggagagcagcatcagctccagatgtgcgacaaaatgcgggaaggcttcatccagttgtagagtctgcacctcactgaatgagccggtgaatccagcccggtcagccagaaaatgcagacgatgaccttcctgcaccagtcgtgctccgaaacacggtgtgatatctcgtttaagcccccaagtttgagtagagtctttattcataattttattcctgttaaagaagaccatgttcggcgaatgagaatatttgcctgccgccgacaatcaggtggtcggggacatggtgaacactttttaacatcctttacccatggtgatcgactttttcttcaggtcgatcacccccactttcgtgctgtaccaccacacctcgtagctgccgtcttcctgcatctccttcagcccgacccgttctcccctgaacgccttgcctgcgctcagacttacccctttcacgctcagctttccgctgatatccactttcctgaccatcaccccttcatcgtattccgggggcgttgtgttgccgctgtactgccgcgctgacggctgataccgcgagcccggtaccgccatatccagcgcctcgtgcgggcgttcaaggttatagaccgtccgccagtggtcgaaggcgcgctgcagttcaccgctgtctgcgaaccattttccctgcagcacttccgccttcaggctgcggtgaaaacgctccagcttcccctgcgtctgcggatgataaggccgggagtgccccacccggatacccaggcgcatcagccacagctccagcgccgtccaggtgccggtggtgtcgccccacggtgagccgttatccatggtcatccggtccggcaggccgtaacgctcaaacacgctgaccagctgctgctgcacggtctcgcgccgttcatcggtacagtgcgccaggcacagggaaaaacgggagtggtcgtccagcagggtgagcggatggcagcgtccaccgccaaaaggaaagtggcccttaaaatccatctgccagaggcggttcggcgcgtcgtgttcgaaccggcccgtggcgggaatgcccggtgaagcgcccggcagcaggccatggcgggccatcaggttatggacggtgctgaaggcgggcatggtgtgcccctggtcctcgagccagcgcttaatcttgcgggctccccagcgttcatgacggtcatgggccatacgcagcagggccgtgatgtcgtcagatgagcggttcggggaatggtgcggaatgcgcgggcggtcctgaagaccggcggcaccttcctgagcccagcgctggagccacttgtagccggtggcaggtgaaatgccgaagcgacggcagagggaacggatgttcgccccgtcctgcgaggcgaacaaaacaaactcagtacgtaatgacatggtatctctcgcatcccagggcataagcgactccataaacgggttcttatgccttagttgtaagtgtctaccatgtccccgaacaagtgttcactatgtccccggaccgtacaccccaaaggggagaggggactgcaccgagccatcttttccccctcgcccctttggggagagggccggggtgaggggcaatatgtgatccagcttaaatttcccgcactccctcttcccttccgatttacctctccttgttctgcgtcatagtatgatcgttaaataaacgaacgctgttctataatgtagaacaaaatgattcagcaaggagatctcatgccgcagtccgcgttgttcacgggaatcattccccctgtctccaccatttttaccgccgacggccagctcgataagccgggcaccgccgcgctgatcgacgatctgatcaaagcaggcgttgacggcctgttcttcctgggcagcggtggcgagttctcccagctcggcgccgaagagcgtaaagccattgcccgctttgctatcgatcatgtcgatcgtcgcgtgccggtgctgatcggcaccggcggcaccaacgcccgggaaaccatcgaactcagccagcacgcgcagcaggcgggcgcggacggcatcgtggtgatcaacccctactactggaaagtgtcggaagcgaacctgatccgctatttcgagcaggtggccgacagcgtcacgctgccggtgatgctctataacttcccggcgctgaccgggcaggatctgactccggcgctggtgaaaaccctcgccgactcgcgcagcaatattatcggcatcaaagacaccatcgactccgtcgcccacctgcgcagcatgatccataccgtcaaaggtgcccatccgcacttcaccgtgctctgcggctacgacgatcatctgttcaataccctgctgctcggcggcgacggggcgatatcggcgagcggcaactttgccccgcaggtgtcggtgaatcttctgaaagcctggcgcgacggggacgtggcgaaagcggccgggtatcatcagaccttgctgcaaattccgcagatgtatcagctggatacgccgtttgtgaacgtgattaaagaggcgatcgtgctctgcggtcgtcctgtctccacgcacgtgctgccgcccgcctcgccgctggacgagccgcgcaaggcgcagctgaaaaccctgctgcaacagctcaagctttgctgagccggacgataacgatgaccattgagaaaattttcaccccgcaggacgacgcgttttatgcggtgatcacccacgcggcggggccgcagggcgctctgccgctgaccccgcagatgctgatggaatctcccagcggcaacctgttcggcatgacgcagaacgccgggatgggctgggacgccaacaagctcaccggcaaagaggtgctgattatcggcactcagggcggcatccgcgccggagacggacgcccaatcgcgctgggctaccacaccgggcattgggagatcggcatgcagatgcaggcggcggcgaaggagatcacccgcaatggcgggatcccgttcgcggccttcgtcagcgatccgtgcgacgggcgctcgcagggcacgcacggtatgttcgattccctgccgtaccgcaacgacgcggcgatcgtgtttcgccgcctgatccgctccctgccgacgcggcgggcggtgatcggcgtagcgacctgcgataaagggctgcccgccaccatgattgcgctggccgcgatgcacgacctgccgactattctggtgccgggcggggcgacgctgccgccgaccgtcggggaagacgcgggcaaggtgcagaccatcggcgcgcgtttcgccaaccacgaactctccctgcaggaggccgccgaactgggctgtcgcgcctgcgcctcgccgggcggcgggtgtcagttcctcggcacggcgggcacctcgcaggtggtcgcggaggcgctgggtctggcgctgccgcactccgcgctggcgccgtccgggcaggcggtgtggctggagatcgcccgccagtcggcgcgcgcggtcagcgagctggatagccgcggcatcaccacgcgggatatcctctccgataaagccatcgaaaacgcgatggtgatccacgcggcgttcggcggctccaccaatttactgctgcacattccggccatcgcccacgcggcgggctgcacgatcccggacgttgagcactggacgcgcatcaaccgtaaagtgccgcgtctggtgagcgtgctgcccaacggcccggactatcacccgaccgtgcgcgccttcctcgcgggcggcgtgccggaggtgatgctccacctgcgcgacctcggcctgctgcatctggacgccatgaccgtgaccggccagacggtgggcgagaaccttgaatggtggcaggcgtccgagcgccgggcgcgcttccgccagtgcctgcgcgagcaggacggcgtagagccggatgacgtgatcctgccgccggagaaggcaaaagcgaaagggctgacctcgacggtctgcttcccgacgggcaacatcgctccggaaggttcggtgatcaaggccacggcgatcgacccgtcggtggtgggcgaagatggcgtataccaccacaccggccgggtgcgggtgtttgtctcggaagcgcaggcgatcaaggcgatcaagcgggaagagattgtgcagggcgatatcatggtggtgatcggcggcgggccgtccggcaccggcatggaagagacctaccagctcacctccgcgctaaagcatatctcgtggggcaagacggtgtcgctcatcaccgatgcgcgcttctcgggcgtgtcgacgggcgcctgcttcggccacgtgtcgccggaggcgctggcgggcgggccgattggcaagctgcgcgataacgacatcatcgagattgccgtggatcgtctgacgttaactggcagcgtgaacttcatcggcaccgcggacaacccgctgacgccggaagagggcgcgcgcgagctggcgcggcggcagacgcacccggacctgcacgcccacgactttttgccggacgacacccggctgtgggcggcactgcagtcggtgagcggcggcacctggaaaggctgtatttatgacaccgataaaattatcgaggtaattaacgccggtaaaaaagcgctcggaatttaattattttaagagataaaaccgtctgcggaatatttcccgcagacggctttgttgtttttgaaatttattaatttaaacaattagttgagatatatcgttggcgtcacaaaagcaaaataacgtaattcggaaataagatatgaccattgctggttaattgaatagctcattacactccattaacacgatgttgtaattcggcacactacataagggtgtaattctgatgacgcaattaaccatgaaagacaaaattggctacgggctgggagacaccgcctgcggcttcgtctggcaggccacgatgttcctgctggcctatttctacaccgacgtcttcggcctgtcggcggggattatgggcacgctgtttttggtctcccgcgtgctcgacgccgtcaccgacccgctgatggggctgctggtagaccgcacccgcacgcggcacggccagttccgcccgttcctgctgtggggggccatcccgttcggcatcgtctgcgtgctgaccttctacacgccggacttctccgcacagggcaagatcatctacgcctgcgtgacctacattctcctgaccctggtctacaccttcgttaacgtgccgtactgcgccatgccgggcgtcatcaccgccgacccgaaagagcgtcacgccctgcagtcctggcgcttcttcctggcggcggcgggctcgctcgctatcagcggcatcgcgctgccgctggtgagcatcatcggcaaaggggacgagcaggtgggctacttcggcgccatgtgcgtgctggggctgagcggcgtggtgctgctctacgtctgcttcttcacgaccaaagagcgctacacctttgaggtgcagccgggctcgtcggtggcgaaagaccttaagctgctgctgggcaacagccagtggcgcatcatgtgcgcgttcaagatgatggcgacctgctccaacgtggtgcgcggcggggcgacgctctacttcgtgaaatacgtgatggatcacccggagttggcgacccagtttttactttacggcagcctcgccaccatgttcggctcgctttgctcctcacgcctgctgggccgcttcgaccgcgtcaccgccttcaagtggatcatcgtcgcctactcgctgatcagcctgctgattttcgtcaccccggcggagcacatcgcgctcatttttgccctcaacatcctgttcctgttcgtctttaataccaccacgccgctgcagtggctgatggcttctgacgtggtggactacgaggagagccgcagcggtcgccgcctcgacgggctggtgttctccacctacctgttcagcctgaagattggcctggcgattggcggggcggtggtgggctggatcctggcgtacgtcaactattccgccagcagcagcgtgcagccggttgaggtgctcaccaccatcaaaattctgttctgcgtggtgccggtggtgctctacgcgggcatgttcatcatgctgtcgctctacaagctcaccgatgcccgcgtggaggccatcagccggcagctgattaagcaccgcgcggcgcagggcgaggccgttcccgacgccgcgacagccgcatcccattaaccggaggcaatatggaaatcactaacccgatactcaccggcttcaacccggacccgtccctgtgccgccagggcgaggactactacatcgccacctcgaccttcgagtggttcccgggcgtgcgcatctaccactcccgtgacctgaaaaactggtcgctggtcagcaccccgttggaccgcgtgtcgatgctggacatgaagggcaacccggactccggcggcatctgggcgccgtgcctgagctacgccgacggtaaattctggctgctctacaccgacgtgaagattgtcgactcgccgtggaaaaacggccgcaacttcctcgtcaccgcgccctccatcgaggggccatggagcgagccaatcccgatgggcaacggcgggtttgacccgtccctgttccacgacgacgatggccgcaaatactatatctaccgcccgtgggggccgcgccaccacagcaacccgcacaacaccatcgtgttacaggcgtttgacccgcagaccggcacgctctcgcccgagcgcaaaacgctgtttaccggcacgccgctctgctacaccgaaggcgcgcacctgtatcgccacgcgggatggtactacctgatggccgccgagggcggcaccagctacgagcacgccgtcgtggtgctgcgttccaaaaatatcgacgggccgtacgagctgcacccggacgtaacgatgatgaccagctggcacctgccggagaacccgctgcagaagagcggccacggctcgctgctgcagacgcatacgggtgaatggtacatggcctacctcaccagccgcccgctgcgcctgcccggcgtgccgctgctggcctccggcggacgcggctactgcccgctggggcgcgagaccggcatcgcccgcattgaatggcgcgacggctggccgtacgtggaaggcggcaagcacgcgcagctgaccgtgaaaggcccgcaagtagccgagcagcctgcagccgttccgggcaactggcgggacgatttcgacgccagttcgcttgacccggagctgcagaccctgcgcattccgttcgacgacaccctcggctcgctcaccgcgcgcccgggcttcttacggctctatggcaacgactcgctcaattcgaccttcacccaatcgaccgtggcgcgccgctggcagcacttcgccttccgggcagaaacgcggatggagttctcgccggtgcacttccagcagagcgcggggctgacctgctactacaacagcaaaaactggagctactgctttgtggactacgaggagggacagggtagaaccatcaaagttatccagctcgaccacaacgtgccgtcgtggccgctgcacgagcagcccattccggtgccggaacatgcggagagcgtctggctgcgggtggacgtggatacgctggtctaccgctacagctactcgtttgatggcgagacgtggcacaccgtgccggtgacgtatgaggcgtggaagctgtcggacgactacatcggcgggcgcggcttcttcaccggcgcgtttgtgggcctgcactgcgaggacatcagcggcgacggctgctacgcggacttcgactacttcacctacgagccggtctaacggctcaggccgggtagcccagcgcgcgcgagagcgcgagcccggcctgctgaagctgctcgcggaaattagccagctccgcgtcgtccacgcgggaggtcagcgtcgacaggctcagggcggcgatgacgcgggactcgtggttccacaccggcaccgccacgcagcgcacgccctgctcgttctcttcgctgtccagggcgtagccttgctcgcgggtctgcgccagggcgctcattaaggcttcgcgagacgcgagggtggcgggcgtaaaggtagtgtactgatagccctccagcagggcgttcagctcggcctcgcccagccaggcaatcaacaccttgccgatggcggtggcgtgcaccggcaggcggcggccgatgcgtgaataggcgatggcggccagcttgccttcaatcttctcgatatagaccccttcacgcccgtccaggatccccagatgggtggtctgcccggtccgccgggacagctccgtcagccagccttttgccttctgccgaatatcgatggagcccacgacaaaatggccgcgctcgaccagcttcatgccgaggcgatacttgccgttctccgggttctgatcgatatagccgtgaagctgcagggtttttagcagcgagtggagggtactcttgctcagccccatcagtttgctgatgtcggtgatcttaagctcggtggcctgctcgttgaacaggtcgaggatctgcaacgcacgttcaacagactgaataatcggcataatgctggcatgtccacgctggaattaaggcgaaaacgtacctttttcgggatgaaaaatcaatgaaatggagccggtgttctccctctccctgtgggagagggccggggtgagggcaccaacgcgcagcggacccaatcactccccaagcgttgccatcatcaccgccttaatcgtatgcatccggttttccgcctggtcgaacacgatgctcgccgccgactcaaacacctcgtccgtcacctccatcccgccgtgcagatcgaactccttcgccatctgcttgccgagcgtagtctggtcgtcatggaacgccggcagacagtgcaggaacttcacgttcgggttgtcggtcagcgccatcatctgcgcgttcacctgatacccgcgcagcagcgcaatccgctctgcccacttctctttggcctcgcccatcgacacccacacgtcggtatagataaagtccgcgcccttaacgcctgccgccacgtcttccgtcagagtaattttcccgccgtgcttctccgccagcgcgctgcactccgccaccaggctctcttccggccagcaggctttcggggccaacaggcgcagatccagcccggtcagcgccgccgcttccagcatcgagttgcccatgttgttgcgcgcatcgcccgcgtagaccagcgtcatctcgttaaacgccttgcccggcaggtgctcctgcatggtcatcaggtccgccagcagctgggtcgggtggaactcgttggtcagcccgttccacaccggcacgcccgcatactgcgccagcgtttcgaccacttcctggccgtgaccgcgatactgaatgccgtcatacatccgcccgagaacccgcgcggtgtccttaattgactctttatgcccaatctggctgccgctcggccctaaataggtaacgcgcgcgccctggtcaaatgcggcaacttcgaaagagcaacgggtacgagtcgagtctttttcgaagatgagcgcgatgtttttaccggtaagcttctgtacttccttgccattttttttatcggctttgagctgtgcggcaagggtcagcagagaagtgaactgtgcaggggtaaagtcgagcagtttcagaaagtgttttttgtataaatcggacattttatcctcgcatggcgaacgccacttattgaattaaaattcactttatatgtgtaattattcatttgcaaccccatttcacaattctttcttacaaaggtggaggcaaacccgtccgtgtgtgaaaataatcgtatctgcctccgattctctgcagaagcagaaagacattggatcgaattctacaaccaggtcgagtcagaaatgagaatgattggccttctttatgattttaaggattatgcttctaaaatggcggagaacatggcgaggcttgctgccttacttcattacttcagcggtgatggaggcgatatatctgttaccgggtaatgactccaacttattgatagtgttttatgttcagataatgcccgatgactttgtcatgctgctccaccgattttgagaacgacagcgacttccgtcccagccgtgccaggtgctgcctcagattcaggttatgccgctcaattcgctgcgtatatcgcttgctgattacgtgcagctttcccttcaggcgggattcatacagcggccagccatccgtcatccatatcaccacgtcaaagggtgacagcaggctcataagacgccccagcgtcgccatagtgcgttcaccgaatacgtgcgcaacaaccgtcttccggagcctgtcatacgcgtaaaacagccagcgctggcgcgatttagccccgacgtatccccactgttcgtccatttccgcgcagacgatgacgtcactgcccggctgtatgcgcgaggttaccgactgcggcctgagttttttaaatggcggaaaatcgtgttgaggccaacgcccataatgcgggcggttgcccggcatccaacgccattcatggccatatcaatgattttctggtgcgtaccgggttgagaagcggtgtaagtgaactgcagttgccatgttttacggcagtgagagcagagatagcgctgatgtccggcagtgcttttgccgttacgcaccaccccgtcagtagctgaacaggagggacagctgatagaaacagaagccactggagcacctcaaaaacaccatcatacactaaatcagtaagttggcagcatcaccgaattttcagcccggatgtttcacgtacctatgtcgaatatctggccgataaggttgcggatcgagaagaggatgcagaggaatatctggaagcaatcatggaggctcgtgttaccgttgctggcatggggctggtgatggaggtgcaggattacttcgatggcgaggccgatagactggcgaaggcgtggctggccgagtacacaccgcaaatcaagtcgttgaaagatgagcgtaaagaggcctatcgtcaaatcgtcgaaatgagtaccgaaccgcaggatgtggatctggtcaggccggcgaacaagtttgaaatgaccagggtgcgtgaaggtgaaaaggaagctgaccttccagtctggaaacaccatttgttgtgtgacgaaagcgggaactatccggctctgttgaaccattgggaaaccaaggtttttgagatcgaaaccaaacgtgaaggatttgctttctggtatcgtaatccacagtacacagggcagtcgtcactgggaatcgcttatgttgaagctgaacagtacaagattgttcgtcccgatttcctgttctttgccgaacaggatggcaaaatggttgtggacctggtagatccacatagcctacatctggctgatgctttgcccaaactggaaggacttgcgctatatgccgaacatcattctgatgcttacaggcgaatcgaatctgtcgccgaagtaaagggtaaattacgagtgttagatttgaaacggcaggatgtgcaggatgctgttgctaccgctgaaaatgcagaaacgttatttagtagcggacttgctgatgactatcagtaatctatagaaaattgcgtaacgaaactgcattttagtaattttttgaaacaatacaaataaggccttctcactgagaaggccattaccgacttacagttcgatttggctacagccgaagttacggtctccttcaccaaacactttgctttcaactttggtcaggtagtccagtcgggttaacagcgcctggtagttctgctggaagtcagtactattggtgtctagcacatacttacagttttcaggaaaatggaccagaccagggtgatcgtctctctccagtctcagggcgctgtaccaggctcctgtgatcatccctctaaggttatcgtcctgatcgtaatccccgaggtggtagtaagcgtctttgttgaacaacaggcaaatgtgatagtggcatttacctgattcagaatactctttcgcccatataataaataaagggcaacggtaaatgcgtttatcctcacgcaccttacgggtacggtcagcctccagcttagctctgagggattcacgcatccgggatatcaccccaggttccaggttagggaagcaacagatattgtcaccgttatcaactattttgggatagtggagatcgacacgtacagcaattaacctaggataccggttagtcaaataacataataatttattaatcttactctgatattcgaggatatgtactccatgagtaccttgatatgttttcataatatatacctgtatttggtcctacggtctatagcagaccgtacagggatgccatacaggcagggctattcctggtcactgttgtcggtatatactggtatcagattttagtacggacatactgatctgattactactcttactggtgaatacaggtagtaagagtacacaatgccattatataatacctatccaacatctaaatttgagacgaaggtagccccagcctgtgatggctgttaaaaagttactctgcaattagcttctggaattaaccgatgattccgttattccagtgccgcttcacagtcgataaactgatactcaatttctttgcaatctcagcctgagtaaatccacctttcttaagtattgtgatatcacgtcggtatttgcttccctcctttcgtcctaattttttcttaacatgtcgatatcggcttttagttgatttcagattgtgaatgtcaatcgtatcctgacgagcaatcaaaaaagacaagcaactttcagcagaaggctctatccttgaagctggatggtagctgtagataaacatttctttttgaaggcaaaaaaataaaatattctgtaagtcctccacagttctgccaagacagcttagatctggaatgacaagcgtgtcctgccggttcatttcatgatgaatcaattgtctgagtaaacgttgctctgaaacaacctctttaatatctacctgctcgatcacaacatgttcaggtagaatattaaatttttggcatatctcagcaagtgagtgatgatctgtaatgctttcttgctgttcgctactgcatatggtgtaaaaaaatgaacgcatctgatgcactccggtgtcataaattattttttgatacctgaataatgtcattttgcataaaaaacaaccaaaaatagagagtgattgccagcgatactttaactggtaaagtagtattttacctctcataattgtttgtccttctttgttacctcttaggttctgctctcttgtgagtatgggtttataatgatgtcatccggtacattaacacggttggaaacatctgttttgcggagcactggcagcataaccaccatttcattgacatggtaaatatcaatccaacaaacaaccggataaggcataacaatcccctttcttctaagaacttcatttatcccgaatataatcaattgggatgttgacaagagtagagcctgcccggcatcaaagtaataaccctcaaaggttgttctatgaataagaataatgtttgaatatcctgagacactttgatgctttacatcaaaatgtctttgattgtaaatgtaaatggctttttccatatcgtaattttcccttagcgaggatagcctttcacgtataactgttttttcatctttccccatgaattcatcattagcgttcagttgaaagtaatctgcaatggggatttttaatggactcatgatgttcgttttccagattaacgaacagtactcttccagagttacttctgttttacctcggcttcgattgatgctttcttttatagagaactttaacaggtcattttttatttcatttattgaccagttatgacgattgcatttttctaatatagggatagccaaatccacaacttccgctattacggaagagtgagatttatttgttagtctggcataatgatcaattactcctaatgaagattgatttttgaacgtgactgagtgtttttttatgggagtagtctgtactacctgtgactcattgtttttgccttgacaaggtttttttcctggtagaacgctgctcatctcaaaattagtaacactattagacatttttaaggaaacctctttgttatctcaatataaaactactatctgaaatttctcagtgttgccccatttttctcggggcaacatcgctataaatcaataaaattaaatctgtaatttattacagactttctcgtacagaaaatgtatctataaaatcgaggacatctttacgtaaccagtaatggcggccattgatttgttttgggcgaggtagcccctcaggcaatttgtcctgacaaagccatttacgaatggtttgagatttgtagctaatgattttagctaactcagctgttgaaatgagctgtgattgagatgtatccgggagtttgaatgcgctcattttgccacctcagtgattgagatattggcaaagaaagctttaagcattattgaattagtaggggtagtaatgaaggcagaaggaaacgtttcgggctcggggtcggggtcactaccatcacctgaatctgatgataaggcacttttagctgatttagccgtactgtgatgcgatctggatgcctgatttttacatgacatcagacgcgcgagaaagttagtagcattttgcattctttgtttaagatgtaaaattttcagtttggcgcatgcgacagacttgcgaagagctgagtatgttcctttgagatactcgacaacctcttccatggacgcaggatcgttaaaggattgagttgttttacttgaattaatacaccagcgagctctgatagctgccagagtgggttctatggatacagttgctggggttgccattggcttatctcctgtgtagttgctgtatcattgactaaactgtgtattacgatacatgaaaatctatcttgatcaatagttgatgatattttgtaatatgttgatttttaatggaatcaacgcatatcaacgttgttttttatggtaatacctgcttcatttaagatccatgtctcaattttctcgtgccattttcgtaacagatctaacggacgacggcgatagtgtttttcggcaagagcgctgggtttgtgtcccataatttgagcaacaataccagtgggaacttcaacccactcggccaaagtaccaaaactacgacgtaaaccgtgaaggctgatatgtggtaactcagccagcactaatgctctgttgtgcgctgaacgcggctcaataattttgccacttttactgttacttctgaaaacccaaccctccttatttacgtcagaatttggggattgcgctagtacatttaacaattcagaaacataaggagtgagagggatgatacgttcaccttcgatcttgtctttaattcgcatgcttgaccatttgaaatctacgtctgaccagcgaagcgacgcaatttcttcacgccgagcaccagtgagcaaaagtacttggagataggccgatgcaataggattattgaggctacgcacggcactaaaccagctttttagttgttccttttgcaggcaatcatcagctttactcgctgacacgggaaccatttttcttacgttgtaatcttgtgccagatcgccaggaatgatcccttgatattttttctgataattactccatttgatgaaagcacgtagtaggcgataagcgtgagcagtgacggtaggtctattttgcctttctgtactcagccacgctgctatgtaatctggggttagctccgataacggcaggttgagcaaactagccaatggtccagccgaagtcgggccttggcctctttttttactttcgcctccacgactggacaagttaatgtgatcggcaatgtatcgagtagaatatgggcgtttagtttttgcactgataccggttctcaattcttgaagatagtcttcccaggcgacggagaaagtcacttttgttttacgtgattctgcctgcagggattctgcttctgcgatttttacagccttagcaattcgtggatctatccctgtatcgatcaatgtttgtaaccgtcttgcctcggctctcgcatcatcaatcttccagtcgttaatgttgccaatagtcatgcgaagggttttccccgcatatacgctttggaatacaaaggcttttgctccgctagttgctcggcatgccagggttgttacatctgcatcccaaagaaaagtttgttttttcccttccggtaaggtgaatctgcgaagtctttcgaaggtaaatttttgtcttgaaagcgccatttttcggctccagttgagaattgctgtcttacaataatgtaactgctggtgtaagtaaatggagggaataaacatcaacttttgttaatttcaatcaacgggtttattgctataacttggtgttttataatataaagtatgttgttttgattgattgctcaagtagttaaaaatgcattaacatcgcattcgtaatgcgaaggtcgtaggttcgactcctattatcggcaccattaaaatcaaagagttaccccatatttaaatacaccacgtttcctcctgtgccgtatttgtgccattgtaaccttggcaattcatcaaaatactgttctgacatcaggcagtgcaggtgcagacatttaagccaattgctgccgccattctttgacgtagtcaatcagggcgcggagctttggtgcaatattgcgacgctgtgggaaatacagatagaagcccggaaattgtggaagaaagtcatcaagcagcgatacaagcttaccgctttcaatatatggcctgaaagtttcctgagtggcaattgttattcctccgccggcaagagccagcctcaacatcagacgcagatcattagtcgtaatctgcggttcaatcgcaaggtcgaaagttctcccgttttcttcaaatggccagcgataaggcgcaacctccggggactgacgccagccgatacacttatgggtatttcccccggaggcgagaaagcactctccacgcccggccgcaaggatcaggacgacgggggcaggcatgaatcctcctcctgatggagacgtacagaggcgacttctgccagcacggagagtgccagagtatgcgcatcccgggctttggggaatatcccgacgggtgcccggatttgcgttgtttcctccctggaccatcccagctcgtggagcttttgcagacgtaacgtgtgggttcgatagctgcccaatgcgccgagataaaagggttttgcttctcgcgcggcctgcaacactggcagctcccggttgagatcatggcacagcaaaatgaccgccgtatcggtatcgatctgagcgctggctgaggccggaaaaagatcgaagatatggctgtcatagcctgtggctgctgcaagactcgcggttgcctgcgcctcaagagaacgtccgtaaatcatcagcctgacgcatggcctgaaccccacctcaaagccattgagattccagcccgtccgggtttgcgtgggcaggcacaccagcgattgtgcttgcggatcgtagcgcagccccaccggttttctctgttccaggcggttcagcacggcgagcagaggctgtgccgagcgtagtttatggagcgtcagcgtgatcccaccgccgcagggcagaacgatgtcaaaccacggcgaaccttcgccatagcgaatttcgcgatcgcggcctgagcccatcatctccagcgcttcaaaagcggcagcggcctccacgcagccgccagagacaaaaccgcagtaacgaccatcttcgcgcaccaccatctgcgccccgagcgggcgcgccgcgccgccgcgtatctccaccagcgtcaccagcaccgctcctttaccggacattagcgcctctacggcgaagcgcagaatggtccggtggtcatcggtgagaaacgcctgctctggcttatgccagtgttcgtctttgtcaaaaagcgggtatgacattgttcctccttaaaccacatccggcagcttatcgagcagcttatccagagtgatgggataatcccgtacccgaataccggtggcgttatacaccgcgttggcgatagccgcgctcacgccgcacaggcccagctcaccgacacctttggccttcatcggggaggatatggggtcggtatcatccaggaaaatcacctcctgttttgggatatccgcatgaaccggcacctcataccccgccatatcgtgattaacgaagtagcccaaacggtcatccaccgccagctcctccatcagtgccgcgcccatgcccatagtcattgcgccaatgacctggctgcgcgcagttttcggattcaggatgcgtcctgcagcacacacagcgagcatacgccggacccgaacttctcccgtcgcgctatgcacgccgacctccacaaaatgcccggcaaaggtcgactgctggtactctttgctcagtgttccgaattcaatgctctcttccgctgtcagtctgccgcctgcggtggcttcatgtagcgtggcgcttcgggtaccgttggtaatcttgccgtcggcaaactgcgactgctcaggatcaaacccgactgccgaggcaatcatttcgcgaagcttcatacaggcggcgtaaacgccggaggtggaggtattcgcgccccattgtccaccagaacccgcagaaaccgggaaactggaatcgccgaggtgaaccgcaacctgctccagcggtacgccaagcatttccgctgccgtctgggccagaatggtgtagctgccggtgccaatgtcggtcatgtccgtttctacggtaacggtgccgttttgttcgaggtgaacccgagcacccgatttttccagcagattattgcgaaagcccgccgcaacaccgtggccgactagccactccccgtcgcgcacctgtccgggtgtggcgttgcgctgcttccagccaaatttatccgctccggtgcgcaagcactcgataagctgacggcgagagaagcagcgcgtcgggtcggcggggtcaacctgagtgtcattcaggatgcgaaactcgacgggatcgatgcccgctttttccgccagttcgtcgatcgcgatttcgagcgccatcagaccgggggcttcgccgggcgcacgcatggcgttcccttccggcaaatcaagcgtggcgagccgcaggccggtatgacgattcgccccggcgtagagtaattcgctttgctgtaccgccgtttccggcgtgccgccgggcaggtttccagaccagctttcatgtgagatagcggtgattttcccgctctggtcggcaccgatacgcaagtgctgaagggtggcggggcggtgcgtggtgttattgggaatagaggggcgggggagcatcactttaaccggacgtttcaccgctcgggcggcgagggccgccagcagcgcatcgcttctcaggaacagcttgccgccaaaccctccgccgatatacggggagataatacgcacattctccacgggaactttcagcgtttttgccagatcggtgcggcaccagtcaatcatctgatttgaggtccagagggtaagcttatttccatcccagacggccatcgaggcatgcggctccatcgccatatggctctggtccggggtcgtgtaggtagcatcaatcttcaccgcagcggaggtgaaagccccgtcaaagtcaccgacgtttttgtcgggcgtgtcttccggcggctgattgacggcctgtttttcgtccgccagggagtaagctcctttattacggcgatagtgtgcctgcaccagcgaggccgccgctcgcgcctgttcgaaggtctcggccactaccagcgcaatggcctgatgatagtgctcaatagtggggccgcctaacagcctggcggtgtttttgtcgcctttgccgagtgccccggcgttactggcggtaatgacagccagtacgcccggcgctttttgcgcggcgtccgtatcaagggcggtgaggcgtcctttggcaatggcggaaccgacgatatagccataggcggcgttgggggcttcttcatgccattcgtaggcgtagcgtgccgtgccggtagttttcagcggtccgtcgatgcggtcatggggacgaccgacaaccttcagctgatcgatcgggttttcccctgcgggtttatcaaatttcatgcctgtgccctcgcttcagccagtacggaggcaagcgttcgcttcgccaacaggagtttaaaggtgttttcagcggtgggatgggcgctggcgaacagcgtgtcatatacggcctgcgccccctgggatagctgagcatccgcagcctcaatgcgccagggcttatgtgctactccgcccagcgcgacgcgcccgctgccgtcaggctgaataatcgccgcgaccgataccagggcaaaggcgtaggaggcgcgatcgcgcaccttacggtagatatgttttccgccgagcggtggaggtaacgtcaccgcaacgataagctcaccgggaagcagggcggtttcaatgtgcggcgtttttcccggagggtgataaaaatcagccagtgtgatactgcgagtctttccctccggcgtgatggtttccaccaccgcatccagcaaccgcattgcgaccgccatatcgctcggatgggtggcaatgcaggcttcgcttacgcctaccaccgcgtgctgacggctaaagccttcaagcgccgcgcagccgctcccgggcaggcgcttattgcagggctgattggtgtcgtaaaaataggggcagcgcgtgcgctggagcagattacctgcggtggttgcctgattacgtaactgaccagacgcgccagcgagcagggcgcgggagagtaccgcgtaatcacgacgcacgcgctcgtgagccgccaggtcggtgttccgtaccagtgcgccgatgcgcagcccacccgcgtcggtcacttcaatcttatcgagcccgaggccgttcacatcgataaggtgggtgggcgtttcaatttccagcttcatcaggtccagcagattggtcccgcccgcgataaattttgcgccgggtacgcgctgagcgctaagtgccgcctcggctggggtattcactcgttcataggtaaacgccttcatgattttatctcccccgcagcatcttcaatggcggcaaggatgttagcgtatgcaccacagcgacagatgttgccgctcatacgttcacggatctcatcggcagttgtttctggagcggaaaccaaatcgaccgtgacgtgactgggaatgccgtcctgaatctcttttagcaccgctactgatgagcaaatttgcccggaggtgcagtagccgcactggaagccatcatgcttgataaaggccgcctgcatggggtgaagattatctggcgaacccaggccttcaatggtggtgatctcggccccctgatgcatgactgcaagcgtcaggcaggcattaagcctgcgaccattgaccagcacggtacaggctccgcactgtccgtgatcgcaacctttcttggtaccgatcaaatgcagattttcacgcaaagtgtccagtagcgtggttcgggtatccacctcaagctgctcggttttgccgttcaccttcagtgtcaggggcattatctctggcgcgggtgtagctgccggaacgcttgccgccagcgtagaatgaggataaaccacggcggtcgccgctgttgcggcgctcactttaatcagatcgcgacgggtcaaacttaaatcgtgcggctcgtgcttcccaacccgattatcttcggggtattcgccttggttgctcataccaggcctccggtattctaaaggggaaaataagagtgcgttgcgagagtgctgatgcttttttaaacgttaagcatagtcggcgacagcaggaggattattcttaaaacgcgaatgcagctatgagcccggctaataaattcatgttcgccgggatgttgatgatgatgggagctggtttattgctttagttgtacgatgcaaaaaccaataaggaaacctgtgattttcagctctacatcaccctgcaaatctctgtcacttctaatataaaaatagggagaaatgatggagcttatattcattggcgattaggaaactatcttgttatacaaaacaatacagttctttacatttgccttgttttatgaatactcctgaagaggtgtataacataatggtacaagcagggtagatatgaatatatttgaacaaactccaccgaaccgcagacgttatggtcttgctgcattcattgggctgattgctggcgttgtttccgcattcgtgaagtggggggctgaagttccattgccgccacgtagcccggtggatatgtttaatgcagcgtgtggcccggaatcattaatcagggctgcaggccaaattgattgctcgcgtaattttctcaatccaccgtatatttttcttcgagactggttggggctgacagatcccaatgcggctgtttatacctttgccgggcatgtctttaactgggttggtgttacgcacattatcttttcgatagtgtttgctgtcggttattgtgtggtcgctgaagtatttccaaaaattaaactctggcagggcttactggcaggtgctttagcccaactttttgttcatatgatttcattccctctcatgggactgacgccacctctgtttgatctcccgtggtatgagaatgtttctgaaatttttggacatttagtctggttctggtctattgaaattattcgcagagatttacgaaacagaattactcatgagccagaccctgagatccctttaggctcaaacagataatgcattgaatgataaaaatggcgcaaatacagcgccatttttataggttaaaaacattgctttttatattctgatgcagatagtcagtgagtatatcgcgctacttcaggatgatgtagatccgaagaacgctacagaagagaggcattgttgctggcaaatagaagaagtatcgggttttgttacccctgaaaaacgaagccccgctattatcgctggcggggcagtgcaattaattattgtatgtttataacggtgtcagcccgtatttagcccttgcacgattgcaagcctcattgacgactccgttctcaccagacatggcgaattctctgcatgtggacgatcgatttttatatatcgtgcagcaggcatttttgcccggggttcctgcaagggcaatacatcgggggtttttctgattggtaccgctcatgcatcggtgaaaaggggatatttgttcagtgagcctggcgggaatagtaccgccagcatcgtcggcttcggcccagtaaaaagagacgcggaaaaatgcacaacaggcaccacacgtcatgcatggattcagattgctcataattcaccagtacagctaaaaatcgtaaagagaacagcggtacatcgtatgtaagaacgtaccgcggttggctggggaactttcgatagtgtgagtattgaatgatttccagccgttaccgattttacgtactaattcgtgattaaaccactcgttagcaggctgcctgatacctttccgtgtctcctgaacactatggtgtgcatatgagaaagcccatcgttacaggtgatattgacgatcgcttccacatcatttaaacgatttttggggctctgaggtggaattcttccctcgaccgatggataagtcttagtccgccgaagggggcttagccggacaggaatcgctaatcttaatgaatttgtcgttatagaccagatagtgattccccggctgacgtaactcaggctgatgaaccacgtctcccggacgtagataccaggcatcgccttcctcttcggtcgaatcacatcctggcttaatcagtagcttaaaccatgtgttgccagtgttacttaccgttcctgtcaccttgtcgaaggaccatttaaactgaacctgacgtggtcgtactaccagaatggtatccatcaccaccaccggctccgtgctgaccacgccgccggttgggctgcgtcttgtatggttacgagtggggacctcgcgaaatgagacccggtagtagcgctcgcggttatcccgtggaccatgatagtaaaatttaaaatactcgctctcaccagcctgcaacgccagctggcggggggcgaaaagcagttcaccatccaccggtcgggtgcgcaattcactgctgcccgggctatcaatagcactgatggcaatacggtatatccgtgcgcttttgttgttattcactacacgtttgctgacaaagtcagtctcggacggcagcgaaaatgtcagattgccgaccgaaatcgcctgtgtcaaaggtgccgccagcatacagaccgctgtcagcagggccttagttaatgttacgccacgtcgcctgaacatgaatctctcctgaagcgctgacttcgccaaaccagccgttatcatctaccgtacgcagcgaaatggcgttatccattggaatcgaaaatttgactgtggtcttatccatctgccccacttcgccagagatatcagtccacggtgtggtcaaccacagcgcatcggtcatatcccgccagctatcatcgcacccggcatcgtaggtttttgtagctccgttgcgggtaataaaggaaagtgtcgccgggaacggtactttcgccttaccgtcatcggagctgaagacacaataggagcgcccgccaatcacctgcgcgggtccggtcaccttgatcagcacttcgtcggcagctgttttaccgctggtggttacgatatagccgaaatcgagtgccgactcgccgctgccaacatatccctcccgcgacggtgtctgagtatattcatcggagataatactgatgctgaaatcacggggtttgataatcagcgtgttggaggtagaaaattcataccagccagactccggtgatgtggtgttctgaaagcgaaagttgaatagatctttggtgttgatatcgctgatcccgaggttcaccatctgcttaaagaagttgctcgagaagaaaacatagatcgagtctgcgctcttcatctcgttgaaggtgtagtaataggcggtattgctcaccggtttccatgaactgccattcagactgaactgcatatcgtacgccccgacggccgaggctaacgacgagttggcgatcgccgggaatatatggattgaggtgttgctgagtccgtttgtttgcagggtatagttaaccatcttacaacttaatcctgaacggctgccgatggtttgcgtccggcagtcggcgttcccttcgcccagagtcggtactccgtcgctgttgataaatacttccgccagcgagtgggtatttatcaaccgtagatttgctgctttcgtatgggtgacgttgcgaacataccagttgccggaggcctgatccttacagcgtgcgccgctgctggcgtcatagttcacagaggtctggcaggcattgatggtcattgtaaagctgctgccgacgggcatttgttgcatatactggtaaaacgcgtctgacaacatgccgtgcatccacttcgcgccgccgctggtcaccgtcgcgccataaaatccactggcgtcggtggtttgcggcaggataagactggtggtcatattacacccagcgtaccagttgatgcagcgcaagccagttaaaggagatgaaactggtgaattttccagccacatatcaaacttccagttggtataaaggccggtgttgtaaccgttatcaatgtagccgaggctttgctgatagatggttcctgaaccagtgtattttaaaccggtccagcggttggcaccggtcaggcgcggatccagcgccccgccaggagtgacgaaaaagttgtcgtctgagttgttttcgacaaacacaaactcgcgtgccggtgcatccgcccaggttgttttgctcactgccgctctgagcgcagttactggccagattagcgcgaaaattatcatcgttattagtaggttaactctcattctcttctcctgtctgcgtcaccgccgcccacgatgagaggccgctgcagaccacatcaccgacccagacggcaccgcgcgcctggttgagttccagagccacttcgcaggttttattgccactgtagcgaaaatcgatagtggggtatttcttatccacgtccatgacaaactcgccgttttcatcggttcgggttcggccgatatggttgttaatccgtgcgttagccagcagtgtgccgtcttccgcacggatacgaccggagacggtaaccatctgcttcacctctggctcaatgacagcgacattgcctggatagagagtcagacgacttttgcggccgctgacgatatcgtaactgtcgagtgagtttttgctgttctgtaactccacctcatatcttccatagggagagagcgggagatagttacgcttgccgttaagcgggaaaatccgcccgttgattttggcgctgatctgaccgtcgtcctccagcccggtgttgaatatcaccccagcgttgccatcagtccgcccgctggcagcaatgtttttaccctgccagccgacgctgccattggcggtcaagttggtattgacgtagccgtccgccgcgctattgacgttcagcgttccgctggcgtaacgagcgtcgaattgtgcatacgccccgccgctgagggttttgtcatcaccggtatcgccggagatggcacgtgacagattggcaccaacagtgcgaatggttccttcatcaaactgtttgcgtgctgacaggtttgccatggtgtagccgttttgatgagtcatccctgcgctaaaccagttgcccagtggtagcgagagatcgagagcgatatattttcctgtattggcgttgctgtcgccgttgttatagcgctgaataccggcccgcaggccaagcgaaccaaaggtaccgctgtagacattttgatagtaatctgccgtgtaataatggctgttgtaacggcggtcatcattgtagctgatgctgaatgtgcccagcttcgaccacagtgagttcaggttgagtgtgccgccgattgcacggttgtcggcatcgctacgtcgcaattgattgccaatgcgggttttttcctgattaacccacagcgaactaaagcctcccggtagagtggcgctgatgctgccgatgctgctccatgagctgtcactggccagcatattttgcaggttaacgttgatcgcccccccaagcggcagcgtcagacgggtttcacccaccgcctgattatcgtatccatatcccgttgccgcccagctaagcgtactcaatgagccggaggtcgaggcacctgctagccaactctctttagctggtcgcgtctttttcccgttttccgaccagcgatccatatgaaagctaccgccccatacctgccacgccagtggtgcaccgacgccgcgcccccggctaaacagcttattgacccgctgggtgcgtttgctgatcacgcgaccgttaacgatcacctcaacttccacatcgtaaatcccgtacggtagaccccgggtatccacttcatgattgcccatagtgaagttctgaacgcttagtagccgcccatcacgggtgagatgtacttcgcccgccgccggtaaaaaggcgatcactggcgtggctgactggctgctgtcgaagatggtggagctggcctggtttccccaggaaaggccgtaaatcttccctgctgaaatggcggtcatcggccctaaggactgcaagttccaggtgtcgagcattccaccggcaaatcggtgaccggcaaaatcgcgttcatacatcgctttatataattcactgtcctgttgaccgctaccgatcccgtacagcgagccgtcgagcaccacatgatgttcgcgcagtgcagtaacgttattcagcgacagatagctggatgtgttgctcccgccgttacgcaactggttgttatagacgcccaagttatagctcagattactgctgagggtgttaacactggactgcccgatgtcttcgctacgtgagcgtagtacggtgcccagcgcttcgcgcttgaccactagctgcagcagcagttggcgcaagctgagatccagctgcgcgttgtcagtcagggggatggtaagggcctcattgaacggggcgttggccagagccatcagctgctgtcgagtttgttcgctgacactggcgttatcttcactctcttccagctgtattttccggatgcgtagctgtccatcgtccagccagataaaagcgctgccgattcgctgatcgtcctggcgaccctggctaccggcgagatgaatatagagcgggacgctcatgccgtcctgaagcgcctgactgaaggcctgcggaataatcaccccacctatttgctgcgcacttatgtcagcagcgctggcatcgggctgaacgaacaaaaagaccatgccgaaggcaaactgggctttcagtcctggggagaaccgtcgtaaaggcattgtcgttatccatctgcacagctatctatttcacgggaatgaacttatcaccctgccaaagtgcaacccgtcctttgttatccgcagtgtccacgcgggtaaaacgacgcgacttgcccggcatcaggtagtaattctctttacactccttaccgttggcggctttcaggcaaggtccgtaggcgaggatccgcagcgtcgcatttcctgtatttgtcagggagccgttggcgtactgaaagtggtagttcgcctgacgaggggcgacgaccagaatggtgccgatgcgggcggaagcagtggccacagcgctgcggttggcattatcgcgctgcgcatcactgagggcctgatcaaaccagacaatgcggtagtagcgctctttttcatctgcgggtcccttatagaagaagcggatcacttcgctggcttgggcgggtagcagcaagctggcgggagtgagtagcaactcatccggcttgtccattgagataacctgcccgtcgtcaagcggtgaagagagccgttcgagacggatattgataaggcgaccactgtcggtactgtttttgatcgttttgctcagcgtgctgctgtcactgttcataaacgatgatatatcgccgacatccagcgcctgggccggagatattccggaaaacagcagagcgagaggcagaaggtgctttttcataacaattccgtccaggaataaagcaggggggctacccctgctggtacatcagagagattaactggtccaggtcgcgtcgaactgtacgctaacgtcgccgctccagatgccttccggtagagtgctgtaatctgttactgcggtggtaccattggtggtaccgctgatgatggagaaggtgaaaccatcctgtgcggtggtacgattgctggcattgtaaccgttagccagcgggctaaggttgccgcccagtacgccgttggcggtatcgatcatcacggtatcgccagttttttcgactgccgcgccgttataatccacgcccacattcagtgtggaacctgaggtatccaactgggttaatgtgttggtgataagacgtgaggtcagtttaaaggcggtagccgttgagtcaccctcgatagccacgtcaaatagacctttctgtgagttaaaacctttaatgccttcggcatactggaacgccaggctaccgagtggcgtcacaaccagcttactggtggtgtcttttttggctgttgccgaccaggtcgctacagcctgagctgttacgtcagcagcctgcgccacacccatgccggtaaacaccgttaccagagctattgccagaaccttttttttcattgcatttcttcccgagttgaattgaggacgtgatgtcccagtgagtcattttttaaaactaacttgcctggagtttactgaaccaacttatatatttttgagtacagcttggcctcagcattacgccgatgggtatacactgtcttcacactacaattttcaattctggcaatcgatttaggttgcattccctgggccgtcatgcggataatttccatttcccggtccgtgattttatctttcttaatatcttttctcaggaacctgccattaatcacatagaccagttcttttctaatatcacgactcagtccagcgtataccacgcccctaatattgctattgtaataccaataatttgctaaggcctctgactttctggccgcaatcaatacgacctgtttcccctttaccgcggataaccattcattatcacggtttataaattcagataaagaatccgtactgagattgataaacacgaaatcttttctaattttctccaacgatagataaattaatctgtcgatatccacaatcagttcagatagtcctttatagaagtaggcgtcatggggagaccagatgtatttatcagaacggttttgacattccatatggtttttaacctcatagtccctactgtaatcactttgccatgtcactactttccaaacctgtaatttttacaggtgcattcagtttccttagtaaaccggaagtaaataagatacgtagtacatatcaataaaggttaaacgagattaagtttaattattttcgattgggcttaaatttatgttttttttcccgatgagtgtcaatatgtgaacggaaaaggaattcaatggttaagtcaatatttagaaaaactgaaaatattgcttttttgataagaagaaaaagacatttggtttcataaggttattggcaatataacgttcaattcttacttgcattttatattggtcaggaactttgccctgaagtgttaggaatagtcttaatgcgctgtgtgatggactagtaaaaaaacaagttttaagggtaagggatagaatataaaactatgatgagctgtcattgaagatgatttgccaatcagtaagatattttaatggattaacatgccgcacaaaatggttacaggtgttcattccaataagtaatggaaaattgaacgggcgtatgtacgtcatctgttcggtaagcccccaagagccagattaagtgaagttaaacgaaggctgccagctgtcacaggaacgatggcctttttgtcagggcactgcattcagttatctgtgcgcgttactctaactggcactcgaacgtcggcgacggggttaccggtggatcagactgttcctgtggcgtaaacgtttttatgttagtaccaacagatttaccacatttatcatcttaacagtttgagtgaaaatgcaggctgcgccgcaaagggaggagactgagtggcgtgttcagtctaaaagagggttgatgccagcatacaggggcgaagctggtcaacaagtcaacattaagataatggaatattcggagagaaacgtcaggcagttggcctcaaatgaacaggaagaatatatccccaggaaaattaatgttggtgttataaacacaccaacattaatccgatctgattattaatcagacaaatatcgttaatccgtcgaattttgaatcaacgttttttcttacgaccctgaacggccttaaaacgtggattagatttacaaatcacatatagccgtccttttcgcttcacaatctgacagtctggatggcgttcttttgcggtacgcagagagttaagaactttcatcacgccccctttttcgtgctaacaaaacgaccaaaacgttgggtgaatcgtgcaacatttccttctgatgccactgttctcagcttccctgtatagaacgggtgcgatttagaagagacatcaattgtcacgtatggatacgttacgccatccagctcaatctcacggtctgttttgatagtcgagccgattttaaagtactcatcaacactggtgtcgtggaacaccacagtacgatactcaggatggatattgggcttcatcatttttacctgttatgttataacataaccataaagatacatgctcatccggatcatttcaacactcaatccctgtgactctttgtggatgtggaattttcgcaacggggaactctggcattgttagcagccattggtgacgctcccataaacgcctggatgagtgattgatgatggttttgctgagagtatggatttttcgagaatggaggttatctccactttactggccgataatttatcgcagtatgattgattacctgacagcgtgtattcctctcccacggatataataattacttacaaaaaagggagaggatgcatattttaaatatcactgaagtgaacagtttatttccgttattaatagaaatggagaaataaataggcgtattctacaattgcgacaaaaacaacgatattaatcagtttatgactgatttgctgtactttattctctttcattggtacttcctcgctttaaaaaagagtgcacttcgtaagtgcccttatataaataacgagtttggtcaaccaattttttgacatgtatcacaaatttgaatagatgtattacatcaactatcttttattgcaccaacgtcattgatatatgtcgcctgaagtcagttccgggaatgagtctgatctcaagactggcccagtccgggcgttgattggtgctgaggagcatatcgcatctcatcataatgtcgtatctcctggggtgttatacaagatatcgttgttggtgacctgggagaggaattgagttctattaaaccgtcaactatgccggatacatactggattacactgcaggcacgccttatgagagaacgtgccgcagtgacgggttaattatctgaaagaatttgtgaggctgtatcggttactcattgatttgatagttttactctcgggagaataatagatatttaatccattaacggaaaccagccagttcctttcgatgcctgaatttgatcccatagtttatccggaatggttaattcatgaacaagttgtgttatcgttcatgagaagcataacgtaaagggaaaagctcgattagacggcagaatttgtcaggggttatgaacgaaattcataaatctgtttgagtgttgcgatgggtagtgcaagttcgatatctccgcaatttacagtccgatgaaggaaaatgaatatccataaaaaatatattggtttatcctggcatatatacctatttcgacgtatttccaatagttttaattaaaggcaggtcattgttattcactctgaatagtgaattattcactgtccgcagagtaagaaatataacttaggtatctatttaatgacttgcacaaaaagctaaattttcccccataaataaaaatataatcccgcgcccaaccacctgatgagtggctataggcactggatatattaggtggcggtgcactttcttacataaaggtatttccttttctgcggaaaaggaaatcgggaaatccccggtttttctgacaagcagacgccattatttgtgtctgcctatgttcgttaattcgttcatcaggaaattatctcaatgtcacattataaaacaggtcataaacaaccacgatttcgttattcagttctggcccgctgcgtggcgtgggcaaatatctctgttcaggttctttttccactcgctgtcacctttaccccagtaatggcggcacgtgcgcagcatgcggttcagccacggttgagcatgggaaatactacggtaactgctgataataacgtggagaaaaatgtcgcgtcgtttgccgcaaatgccgggacatttttaagcagtcagccagatagcgatgcgacacgtaactttattaccggaatggccacagctaaagctaaccaggaaatacaggagtggctcgggaaatatggtactgcgcgcgtcaaactgaatgtcgataaagatttctcgctgaaggattcttcgctggaaatgctttatccgatttatgatacgccgacaaatatgttgttcactcagggggcaatacatcgtacagacgatcgtactcagtcaaatattggttttggctggcgtcatttttcaggaaatgactggatggcgggggtgaatacttttatcgatcatgatttatcccgtagtcatacccgcattggtgttggtgcggaatactggcgcgattatctgaaactgagcgccaatggttatattcgggcttctggctggaaaaaatcgccggatattgaggattatcaggaacgcccggcgaatggctgggatattcgtgctgagggctatttacccgcctggccgcagcttggcgcaagcctgatgtatgaacagtattatggcgatgaagtcgggctgtttggtaaagataagcgccagaaagacccgcatgctatttctgccgaggtgacctatacgccagtgcctcttacccagcaatagtggacacgcggctaagtgagtaaactctcagtcagaggtgactcacatgacaaaaacagtatcaaccagtaaaaaaccccgtaaacagcattcgcctgaatttcgcagtgaagccctgaagcttgctgaacgcatcggtgttactgccgcagcccgtgaactcagcctgtatgaatcacaactctacaactggcgcagtaaacagcaaaatcagcagacgtcttctgaacgtgaactggagatgtctaccgagattgcacgtctcaaacgccagctggcagaacgggatgaagagctggctatcctccaaaaggccgcgacatacttcgcgaagcgcctgaaatgaagtatgtctttattgaaaaacatcaggctgagttcagcatcaaagcaatgtgccgcgtgctccgggtggcccgcagcggctggtatacgtggtgtcagcggcggacaaggataagcacgcgtcagcagttccgccaacactgcgacagcgttgtcctcgcggcttttacccggtcaaaacagcgttacggtgccccacgcctgacggatgaactgcgtgctcagggttacccctttaacgtaaaaaccgtggcggcaagcctgcgccgtcagggactgagggcaaaggcctcccggaagttcagcccggtcagctaccgcgcacacggcctgcctgtgtcagaaaatctgttggagcaggatttttacgccagtggcccgaaccagaagtgggcaggagacatcacgtacttacgtacagatgaaggctggctgtatctggcagtggtcattgacctgtggtcacgtgccgttattggctggtcaatgtcgccacgcatgacggcgcaactggcctgcgatgccctgcagatggcgctgtggcggcgtaagaggccccggaacgttatcgttcacacggaccgtggaggccagtactgttcagcagattatcaggcgcaactgaagcggcataatctgcgtggaagtatgagcgcaaaaggttgctgctacgataatgcctgcgtggaaagcttctttcattcgctgaaagtggaatgtatccatggagaacactttatcagccgggaaataatgcgggcaacggtgtttaattatatcgaatgtgattacaatcggtggcggcggcacagttggtgtggcggcctcagtccggaacaatttgaaaacaagaacctcgcttaggcctgtgtccatattacgtgggtaggatcataaagtcctcgggtcgttgtccactcttttggcatgtcagcatattcacataccgtaccagcaaaagtttcaaccgtgagcaaatcgaccgattttgttgacggttcaaacgtggaaacgaaatagatatccgtcttaaaattcttcatacatctggctaaatgatgacgtcgtagtttgacttcttcatccggtgatttattcgacacttcaatgtcatatttaaatgagttgccaaaaataggtgtctcaggaaagttgattaatctacactccgtcttttgctgttgacgtattaaaaaagaagggaagatatttgcgagatcccaataatcacggtggcggtattcacggggagagcagccgaataactttttaaattcgcggctgaatgactgctgtgaatcaaaatgcaaagagagtgcaatatcaagcatagatttcgcggtgagccggacaagaatggcggcacgacaaagccttcgtttgcgaatgtattctcccaaaggcacatgcatgaaatttcggaacagaagctggatgttgcgtctgctgtagccagatttctgtgcgatatcttcgattgaaatagggtgctcaagattgcactcaatccactccaggagctgctgtagaatcttctgcctgatcatctcattctccgttaattctttgtcatatcgcacattttcgttataccctgggccctaagtgtatcaaaaatagcaagggcgaaggcaaaagcactggtagcgtctgcttcgttgtccccgaaaatagagaggtttcagtcctacattattaatgaattttttgcataagtgatatcaaaatccacatactactttgaggttacgttttaacgtagactcattgttcatgcctaatggagggactgacagtggaattttccgtatagtctgcttcagagtattgcagatgcccatcaaaaatcgatttctcactgacagataaagaaatggcacaaattagttcgcttgatttgggttatgttggggagtcggtaaaacattttaatcctgaatttgttcgtggttgtcttgctgtaaaaatacatgattgatattaatcatgtattttacctaagacgacaaaaaccttttaacagggagtgatattgatcttcactctgtcatatctccggtaatatggcgtcaggcttcatcatcagaaagggggcctgacgcctgaaaaagtgaacaacagacagtgttcggattatcaatattcagtttttaacgttgaactggattcattactgcgttgtttaagaatttcccgcgccgaatctgccattatcatgactgcacctgccagcatcagagtatctttcaataccaggcgaccagcaccggataaataagggaaaccatgatgagcgtcacccaatgcgggtacccatgcctccggggtggtgattaaaaatgagagtgttaccagcggcgtggtaaatgccatcagtcctcccaataaacctaaccagcgattgacaggattagccaaaaccagcagagcaataatcacctccacgacgccaagaccgttggaaaaaccataggtattattggccgtttgccatgcccttgcttctggtttgtattcgccttcgtgagtcagatactgtttatagtcttccgggtgttcataaaagaacgacattagtggactgtttgcgacgaatggtgtaatgctgtctgcctcgtaagggacaaactttaataacccaatccacataaaaacaattgcaatactcagacgaatcaatgtcaggccaattttatctccccgacttaacaggtgcaggtatttttccattgtgaacatccttatttatacaatactgctgttgcggttgaattattatcaattcgcatcgatgtgactttccaggatgaagcattatattttctggctatatcagcaatggtatcctccagaactgtcggtgatgctgatactgacgagacgctgatatgtttcagaattattttatcatctgcattggtggaaaatgccataacgccagataatagtgttgcaaataaaacagattttttaaacatataaaataccatcaatgaagtgattaagaagttatagagtaacagagaattaataagattcttttctctgagacgccagaatatttgttctggcgtctgattttgagtttatttgactaatgaaaatagatcattgagtgattcgctcatcgacggatgagtaaatatctgatcgcgtaatatgctataaggcagcccggcatccatcaccattttcactatattgatcatctcgtgggagtcaacacacagcagtgatgcccctaacatacgttgggttttattatcaacaatcgcttttaataccccacgagtatcattcatcactctggcacgcggaattgcagctacaggcaatgtcaccacctgaatatcagcaccactctctctggcttgttcttctgtcataccaaccctggacaggggcggtgtcataaatacggaataaggcacatttttccgatcatcagtactacgtttgccttcacccagtaactcatcacgtacaatgcggtaatcatccagtgatatgtaagtaaattgcagcccgccggtaacatctcccatcgcccaaatattgtctgcggtggtatgtaatcgcttgtcaacgacaattgccccgcgctcgtttactgcgataccggcattttctggatgtaacgaagcggtagccggttgacgaccggaagctattaacagtgcatccaccgccagttgggcgtgctcgctatgcacttgcacttgattttcatggtgactgattcgctccacatgggcattgaggataatatcgacgccctgatcgcgtaaaatcgtcgcgatattatcagcaatatcccgatcttcccgaggcaaaaacagcgaagctgcttctaaaatggttaccttgctgccaaaattagcgaacatagaggcgaactcaacgccaatatatccgccgcccaaaatacctaaatgcccaggcaattcttttagattaagtaatccggtgctgtcatatactcctggcgtggtggtaattccaggaattggcggaaccacggtttgtgcaccggtattaataaaaattttctcgccatgaatttccagatttccctcaggccgatgaacacgcaggctatgattattgataaactccgcctggccgtcgatcacgtcgatattgggcatatccgcaagattatgaaaattcttattacgtaaaaaattaaccacttcatttttacgctgtatggcacggacaaaatctgtgtgctgctgtgcgtcatgaaccaatgttttggttgggatgcagccgatattaatacaggtcccgccatacattgcatttgattgttcgatgagagccactcgccaacctgcttttgccagcgtgacggctaatgtttttccagccttgccaaaaccaataatcactgcctgatatttattcatgatgatttcctgtcgaaacgcgttcatttgacatcatgactatagacgcaaaagagcaaataacatttcttcacaacgcttgatattttgtcttatcgtctgatattttctttttcttaatcagaatcacaaaacaaaaatcatgattaactatttgatggtattagattagttatttactaagattgttggtgtttgtaatcaaaaaccactcaggagtctgatatggatgcccttagccgtttgttgatgcttaacgctccacaaggaacgatcgataagaattgcgtgttaggaagtgactggcagcttccacatggtgccggggaattatcggttattcgttggcatgcgttaacgcaaggagcggcgaagctggaaatgccgacgggggagatttttacattacgcccgggaaatgtggtcctgctaccacaaaattcagctcatcgcctgagtcatgtcgataatgaatcgacctgtattgtctgcggcactcttcggttgcaacattcggcgcgttattttttaacgtctttgccggaaacgctgtttttagcaccggttaaccacagcgtggaatataactggctgagggaggcgatcccgtttttacaacaggaatccagatcggcaatgccgggagtggatgcactgtgtagccagatctgcgctacattctttaccctcgcggtgcgtgagtggattgcacaggttaatactgagaaaaacattctcagtttgcttctgcatccacgtcttggtgcggtaatacagcaaatgctggaaatgccaggacacgcctggaccgtcgaatcgctggccagcatcgctcacatgtcccgggcaagttttgcccagcttttccgtgatgtttccggaaccacgccgctggctgtattaacaaagttgcgtctacaaatagcggcccagatgttttcccgggaaacgctccctgttgtggtgatcgctgagtcagtaggctatgccagtgaatcatcttttcacaaggcgtttgtccgcgagtttggttgtaccccgggagaatatcgggaaagggtcagacagcttgcaccctgaataaaaccgccagaaatcagggcaaagataatccgcattccgggagttgtgagcctttcaactatttctatttccaacggtggtttgggctttatatattttttctgatggactctagctcagtttttaaataaaaatgcaaactaaattgcttcaattaaataaaatcccgactattacttgatacgtgattattgtcggtgatttttttgtacaccatcagtgtatatctcaataacccctgaataagtagctctgaataggtataagggatgtagccatttttaaatggatttcttatgccaaaaatgatcgtcgatttccccataaaatgtgagcgatgccgaaagaaataaaattagttattgcatttgacgtttggatgaaagattatcatttgtcatacaaatgaggggtggtatgttgctagccaattaaaaaagaacgccatatttattgatgattgatcccccggtgggggggaaacatcgggcataaatgggcatgaagtaatggagtattagttgtgaatgtcaatttctttgtcacctgtattggtgacgccctgaaatcaagaatggcacgagactccgtgctgctactggaaaaactcggctgtcgcgtaaatttcccggagaaacagggatgctgcggtcagcctgcgatcaatagcggttatatcaaagaagcgattccagggatgaaaaatctgatcgccgcactggaggataacgacgatcccattatttcaccggctggctcttgcacctatgccgtaaaaagttacccgacgtatctggcggatgaacctgaatgggcatcacgtgccgcaaaggttgccgcgcgtatgcaggatctcacctcttttattgttaataaattaggggtagtcgatgtaggtgccagtttgcaagggagagcggtgtatcacccatcttgtagcctggcccgtaagctgggagtgaaggacgagccacttacgctgctgaaaaatgtgcgtggactggagctgttgacctttgctgaacaggatacctgctgcggatttggcggcacgttctcggtcaaaatggccgaaatatccggcgagatggtgaaagaaaaggttgcgcacctgatggaagtccgccctgagtatttaattggtgctgacgtgagttgcctgctaaacatcagtgggcgattacaacgggaagggcagaaagtcaaagtgatgcatattgctgaagtgttgatgagccgctgaggatataaagatgtcgatcaaaaccagtaatacagattttaagacacgcatccgtcagcaaattgaagatccgatcatgcgcaaagcggtggcaaacgcgcagcagcgtattggggcaaatcggcaaaaaatggtcgatgaattggggcactgggaggagtggcgcgatcgggccgcccagatacgtgatcatgttctgagtaatctcgacgcttatctgtaccagctctcagaaaaagtgacgcaaaacggcggtcacgtctattttgcaagaaccaaagaagacgctacccgctacattttacaggttgcccaacgcaaaaatgcccggaaggtggtgaaatctaaatcgatggtgaccgaagagattggtgtcaatcatgtgttgcaggatgctggcattcaggtgattgaaaccgatctgggtgaatatattctccagctggatcaagatccgccatctcatgttgtggtcccggcaattcataaagatcgccatcagatccgtcgagtgctacacgaacgtctgggctatgaggggccggaaacgcctgaagcgatgaccttattcatccggcaaaaaatccgcgaagatttcctcagtgctgaaataggtattaccggctgtaatttcgcggtggcagagaccggttcggtatgcctggtgaccaatgaaggtaatgcgcgaatgtgtaccacgctgcctaaaacgcatattgcagtgatgggaatggagcgtattgcccccacgtttgccgaggtagatgtattgatcaccatgctggcgcgcagtgccgttggtgcacgtttgacgggatacaacacctggctgacaggaccgcgcgaagctgggcacgttgatggtcctgaagagtttcatctggttattgtcgataacgggcgttctgaggtgctggcctctgaatttcgggatgtgctgcgctgtattcgctgcggggcttgtatgaatacttgtccggcatatcgccatattggcggtcatggatatggctctatttatccagggccaattggtgcggtgatttctccgctacttggcggctataaagattttaaagatttaccctacgcctgctctttatgcacagcttgtgacaacgtgtgtccggtgcgtattccgctgtcaaaactgattttgcgtcatcgtcgggtgatggctgaaaaagggatcaccgcaaaagcagagcaacgggcgataaaaatgttcgcttatgccaatagtcatccaggattgtggaaagtcgggatgatggccggtgctcatgcggcaagctggtttatcaatggcggcaaaacaccactcaaatttggcgcgattagcgactggatggaagcacgcgatcttcctgaagctgacggagagagtttccgtagttggtttaagaaacatcaggcgcaggagaaaaagaatggataatcgaggcgaatttttgaataacgttgctcaggcactgggtcgcccgctgcgacttgaaccgcaagcagaagatgcgccgcttaacaactatgctaacgagcggcttacccaacttaaccaacagcagcgctgtgacgcgtttattcagtttgccagcgatgttatgttgacgcgctgtgagctgaccagcgaggcgaaggcggcagaagctgcaatacgtctgtgtaaagagctgggagatcagtcggtcgtgattagcggtgacacgaggctggaggaattggggattagcgaacgtttgcagcaggaatgcaatgccgttgtttgggatccggcgaaaggtgccgagaatatctcgcaggcagagcaggctaaagtgggtgttgtgtatgctgaatatggtttaaccgaatcgggaggcgtggttcttttttccgccgccgagcgcgggcgttcattgagcctgctcccggaatattctctttttatcctgcgtaaaagcactatcctgccgcgtgtagcgcaactcgcagaaaaattgcatcagaaagcgcaggccggtgaacgaatgccttcctgcattaacatcattagcggccccagttcaacggcggatattgagcttatcaaagtcgtcggagttcatggcccggtgaaagcggtgtatctgattattgaggattgttgagagagatatgaagtctggacataaacctgaagaaggcatacgaggttgaaaatagcgtttaggacaacctgacttaaccccgttccgtcatggttatgctgctcttctgtaaatatcctggtattaccaatgccaggatatttacagtgaaaaagacaggcatccattcctgaaaacgggttcccttcccggtcattgtcacttcagctttatacaggcactctctatcagaatgttgtttattactgcccagagttttgttggtattcatctaccatttttttgacaaggcaaaacattacagaaattacaatgcttagaaaaaatcccagagccaggcaaatggcagcagggtatttattttttatttctggtgagcttatagttacacagccatcaccgttcggatacaatgaccagttcctggtcaggtatatcatttttgtataaagctcactgttaattgctgaaggcgtttgtatctcatcgagaacttgcctgccattatgatattctgacgcataccatttgataatagaggcctgcacgcgagatatttcctcttcagcagttggtaaagctctcttatctcctgaccattccagccttatttctctgttcttgacatctgggctggtgtgaaaaaatgtagtaattcgctgaataacatcttcagtcattgtagtctgacaggcaaaattattattgctatcacagctaacaagtatacctggcgttgtctggtttatttttaggctgtaaatcacttttatattgtctttattgatatacagaaacaacagcaccatagccatacatatagccataataaaaaggataacacgaatctttttcttcagataaaataaaatctcaatcagatcgatatcctgtttgatttgttcacgcataatatatccagagaataaaatctgtcgcagataaggttgtattaatagtctgtatcaggaatgttcgggttaaatatcagcaaaaagcccgcatcatgaatactggatatgaagcatgagagttacctcagtgtttatataaggattcggtccccctctctggaacggtaactctcaatctgatcggttcctgcgttagttcacatcacgactcattttttcgctctcaccggcatcccatttgccacaaaatatcccgccgtgctcctcggcagcgcttcctgtccacgaatcatatccgctattttctcgccaatcataattgtcgtggcgttcaaattcccggtgataatctgcggcataatcgacgcatccaccacacgcaggccttctaacccgtgtacgcggccttcgccgtcaaccacggacatctcgtcgtaacccattttgcaggtaccgcacggatggaaggcggtttcggcgtggttacgcacgaactcatcgagctgttcatccgtctggcattcgacaccggggctgatttcgcggccacgatactgatccagcgcgggttgatgcatgatctcgcgggtgatgcgaattgcgtcgcggaactcctgccagtcctgctcgtgcgacatgtagttaaacagaatcgccggatgctggtgcgggtcgcgggatttaatccgcacatgcccacggcttggcgagcgcattgagccgacgtggcactggaaaccgtgctctttcactgcattcgagccgttatagttaatcgctactggcaggaaatggtactgaatattcggccacgcaaattcctcacggctgcgaataaatccacctgcttcaaagtggttgctggcaccaacgccagtgccgccaaacagccactccgcaccgattttcggctggttccaccactgcagggcagggtagagggaaaccggttctttgcactcatattgcagatacatctccagatgatcctgaagattttcgccgacgccgggtaattcatgcaccagcggaatatcaaactccgccagcagttcagcgttgccgacgccggagcgttgcaggatctgcggtgaggcaatcgcgcctgcacataacagcacttctttgttggccgttgcgcgggttgggatggtgctgtcgccttccagccattcgacgcccaccgcgcgtttgccgtcaaaaatgatgtgatcggtcatagcgtgagtacgaatggtcaggttaggacgcgatttggcctgatcgagatagccacgcgcggtgctggcgcgacggccctgcggcgtgacggtgcgatccatcggaccaaaaccttcctgctgataaccgttgagatcgtccgtgcgcgggtagcccgcctgcacgcccgcttcaatcatcgcttcaaacagcggattgacgccgggtttggaggtagtgacgctcaccgggccatcaccgccgtgatagtcgttttcacccatatcgcgagtctcggccttgcggtagtagggcaggcagtcgaggtagctccagttctccagaccgggttcttgcgcccagttatcgagatccagcgcattgccacggatgtagcacatgccgttgatcagcgacgatccacccagacctttaccgcgtccgcactccatgcggcggttattcataaacggttcaggttccgtttcataggcccagttgtagcgtttaccctgtagcgggaatgccagggcagcgggcatctgggtgcggaagtcaaagcgatagtccgggccgcccgcttcaagcagcagcacggaggtattcggatcttcagtcagacgggtagcgagaacgttgccggctgagccggcaccaataatgatgtagtcaaattgcaaataaacctcctggttagaatatggactggaatttagccatctcaacctggatggacttcacctgggtgtaactctggagcgtcatcacgccgttctcgcgaccaatgccggagtgtttgtagccgccaacgggcatctctgccggggattcgccccaggtgttgatccagcaaatacccgcttccagctgatgaatgacgcgatgcgcgcggttcaggtccgctgtcacgatgcccgccgccaggccgtagtcggtatcgttagcgcggcgaatgacttcgtcttccgactcgtaggtcagaatggacatcactggcccgaagatctcttcacgcacgatggtcatatcgtcgctgcaatcggtgaacactgtcggtgcaacccatgcgccgttatcgaagccatcgcctttcagtacatcgccgccgcacagtacgcgcgcgccttcctctttgcctttggcgatatagcgcagcacgttatcgcgatgcgggaagctgaccagcgggccgaagttagtttgcggatcgaaaacgtcgcccgcgcgaatgcgctcaacgcgcgccagaattttctgctcaaatgcggctttgcatttcgccggaacgaagacgcgggtgccattggtacacacctgaccggagctgaagaagtttgccatcatggcgatatcggcggcgagatcgagatccgcatcatcgaaaacgatcagcggtgatttaccgcccagttccatggtcacttctttcagggaagaggccgccgagttagccatcacttttttgccgctggcgacaccgccggtaaatgacactttggcaatgcccggatgctcggtcagatattgcccggtctccgcgcccacgcccggcaacacgttaaatacgccgtccggcaggcccgcttcgctgtaaatttcagccagctttaacgcggtaagcggggtaacttcgctcggtttgaaaatcattgcgttgcctgccgccagcgccggggcggatttccacagggcaatctggatcgggtagttccatgcgccaatccctgccactacgcccagcggttcgcggcgggtatacacaaaggacgtttcacgcaacgggatctggctgccttccagcgccgggatcagcccggcgtagtactccagcacgtccgcaccggtaacgatatcgacggttgaggtttccgaatatgcttttccggtgtcgagggtttccagttttgcgagttcgtcattgcgttcacgcagaatatcaacggcccgacgcagaatacgcgagcgctccatggcggtcatcgacgcccagattttttgcccctgctgggcgcttttcacggcgcgatcgacatcctcgcgcccggcggcctgcacggtcgccagcacgttaccgttggccgggttaatggtctcgaaggtgcgaccgctggtggcggaggtataaccaccatgtatataaagctgctgttctgccattcgggacatcacgtctcctcggttaatcggtgggtagatgctgagtgataaagtggcgggtcagggaattagcgcgggttttatccagcggtttgccgctcagagccgcgcgcagccataatccatcaatcagcgcggccaggccgtagcccgcttcctgtgcctgttcgcgcggcaattcgcgacgaaactcgctcaccagattcgacagcaagcggcggctgctgacctgctgtaaacgatagagcatcggctgatgcatactgctggcccagaacgccagccaggctttcatcgccgcactgctcacctgcgtttcatcgaagtttccgccaacaatcgcctgtaatcgctgctctgcactgccctgcggaagtgcatgtaatcgattcaaaaccgcgtcacgcagctgactggtgatatcgcgcatggttgcttccagcagaccatttttgtccctgaaatagtggctgatgatccccgtagaaacgcctgcacggcgggcgatctgcgcgatcgttgcatcgtgcatgcccacttcatttattgcttccagtgtggcgtcgatcagttgtctgcgccggatcgactgcatccccaatttgggcattttcgccactccattcatcagcggtgtttatctattaaagcggttattgattggacgttcaatataaaatgtgtcttaattgttacgaatttgattttaaatagtaacaataacagtggggatactggatgacagacctttcacacagcagggaaaaggacaaaatcaatccggtggtgttttacacctccgccggactgattttgttgttttccctgacaacgatcctgtttcgcgacttctcggccctgtggattggccgcacgctggactgggtttctaaaaccttcggttggtactatctgctggcggcaacgctctatattgtctttgtggtctgtatcgcttgttcgcgttttggttcggtgaagctcgggccagaacaatccaaaccggaattcagcctgctgagttgggcggcgatgctgtttgctgccgggatcggtatcgacctgatgttcttctccgtagccgaaccggtaacgcagtatatgcagccgccggaaggcgcgggacagacgattgaggccgcgcgtcaggcgatggtctggacgctgtttcactacggcttaaccggctggtcgatgtatgcgctgatgggcatggcgctcggatactttagctatcgttataatttgccgctcaccatccgctcggcgctgtacccgatcttcggtaaacggattaacgggccgataggtcactcagtggatattgcagcggtgatcggcactatcttcggtattgccactacgctcggtatcggtgtggtgcagcttaactatggcttgagcgtactgtttgatattcccgattcgatggcggcgaaagcggcactgatcgccttgtcggtgataatcgccacgatctctgtcacctccggtgtcgataagggcattcgcgtgttatcggagcttaatgtcgcgctggcgctgggattgatcctgttcgtattgtttatgggcgacacttcgttcctgcttaatgcactggtgctgaatgttggcgactatgtgaatcgctttatgggcatgacgctcaacagttttgccttcgaccgtccggttgagtggatgaataactggacgctcttcttctgggcatggtgggtggcatggtcgccgtttgtcggcttgttcctggcgcgtatctcgcgtgggcgtaccattcgccagttcgtgctgggcacgttgattattccgtttaccttcacgctgttatggctctcggtgttcggcaatagcgcgctgtatgaaatcatccacggcggcgcggcatttgccgaggaagcgatggtccatccggagcgcggcttctacagcctgctggcgcagtatccggcgtttacctttagcgcctccgtcgccaccattactggcctgctgttttatgtgacctcggcggactccggggcgctggtgctggggaatttcacctcgcagcttaaagatatcaacagcgacgcccccggctggctgcgcgtcttctggtcggtggcgattggcctgctgacgctcggcatgctgatgactaacgggatatccgcgctgcaaaacaccacggtgattatggggctgccgttcagctttgtgatcttcttcgtgatggcggggttgtataaatctctgaaggtagaagattaccgccgtgaaagtgccaaccgcgataccgcaccgcgaccgctggggcttcaggatcgcctgagctggaaaaaacgtctctcgcgcctgatgaattatccgggcacgcgttacactaaacagatgatggagacggtctgttacccggcaatggaagaagtggcgcaggagttgcggttgcgcggcgcgtacgtggagctaaaaagcctgccaccggaagagggacagcagttgggtcatctggatttgttggtgcatatgggcgaagagcaaaactttgtctatcagatttggccgcagcaatattcggtgccgggctttacctaccgcgcacgcagcggtaaatcgacctactaccggctggaaaccttcctgttagaaggcagccagggcaacgacctgatggactacagcaaagagcaggtgatcaccgatattcttgaccagtacgagcggcaccttaactttattcatctccatcgtgaagcgccgggccatagcgtgatgttcccggacgcgtgattgttattgcataaaaccgcgccatgtctgcatatggcgctgtttctcctacctcttgatacgttatatctatacggttaagcccttagtatctattgatgattaccagacaacagataataaaaaagaaaagaactattgcagcccaaaacctacatttgggctgttgcgaatgttcaataagtttagtcttatttaatgtaaatattgctgatcatttgaaatgacgcattattcatgagaaatgtgtatcgtaaatcaactgaaattaacgcaaccatttgttatttaaggtttaattatctgtgtgtgatattttattgaatgttttaaatattgtttttattggcattgctataatattggttatcatttgctgaatggattcagtcttaatgagtgggtttttaagggacaggcatagagtaatgatacgtatgcataaccaacatctttactcattatgtcattgaatgttgacgctatgtgtttatgagggagaggtattttcagttgatctggattgttaaattcatataatgcgcctttgctcatgaatggatgccagtatgtagtgggaaattataaatattgaaatagtccaactacttctttattaccaaaaatgagtatctgaattttaatattgcattcttgcgtgattatctcctgagtttgacttgtgattacctttttaaggtatttagcgtaactgtttttgagcgagcatcagaggtaaagataatcttcttgatagtgatgtgggatgttatacgtatggcatcgctgatgtttatggttaccccttatgtgtgctcaggaatcgacaggtaatcactcatactgaacagcgataaaagataaaggtgtgttcatgaattcatgtgattttcgtgtttttctgcaagagttcggtacaacggttcatttgtcattgcctggtagcgtatccgagaaagaacgactgctactcaagctgctgatgcagggaatgtctgtaacagaaatatcacagtacagaaatcgcagtgcaaagacaatttcacatcaaaagaaacagctctttgagaaactggggattcagagcgatattactttctggcgcgatattttctttcagtacaatccggagatcatatccgccacggggagtaatagtcacagatatattaatgataatcactatcaccatatcgtcacgcctgaagccatcagtctggcgttggaaaaccacgaattcaaaccgtggatccaaccggttttctgcgcgcagactggcgtactgacgggctgtgaggtgcttgtccgctgggaacatccacaaacgggaattatcccaccggatcagtttattcctctggcggagtcatccggtcttattgtcataatgacccgccaactgatgaaacagactgcggatattctgatgccggtaaaacatttgctgccggacaatttccatattggcatcaacgtctcggcgggttgttttttggcagcgggatttgaaaaagagtgtctgaacctggttaataaattaggtaacgataaaatcaagctggttctcgagctaacggaacgtaaccctattccggtaacgccagaagccagagcgatatttgacagccttcatcagcacaacattacctttgcgctggatgactttggtacgggttatgcgacctatcgttacttgcaggcgttcccggtcgattttattaagatcgataagtcatttgtgcaaatggcgagtgtcgacgaaatctccggtcatattgtggacaatattgtcgaactagcgcgtaagcctggtctgagtatcgtggcggaaggggtagaaacccaggagcaggcggatttaatgatcggtaaaggcgttcactttttgcagggctatttgtactctccgccagtaccgggtaataaatttatctctgaatgggtaatgaaagcaggtggttgatgtaaaccgctattcacagcgcatcgggaggttggcagcgattaattctcccgatgcagtaaatcctgatagatccccgttaatatgccatttggcgcaaattgttttttaatccactgcgtcacctgacccgtagcagaatgctgagtcgccagtaacatgcgcgaatcctggcgcggattatggatttgtcgggtaaccagcagggattgcgtcatcgcctcacggaccatgtaatccggcaaaaaaccaattccttcacctaaaatctggcactgacatttggtgttgaaatctggcaccagaattgactcctgcccgtgcagcaaccagcccacttttttattaatcgtatgcgcggtgtcctccaccataatattagggtagagacgcagttggctttcggcgatgggttccggcacaaaggctaacgggtgatccggggcgatagcaaaagcccagcgaatcgcgccaatttcagtgtaatcaataccgccgccgtccagtagtgtatcgggtgcgccgatggcgatattggcctgattattaataatcgcatcccagacgccgttatacacttcggtggtgacggtaatctggcaggtaggaaactgctttttcagcacctgtaacaagcgtgcggtgtgtttgggcgtataaagcagctgattaatacaaatgcgcacacgcgcttctatgccctgcgaaatagtatcgattctgcgtttgatggcataaaaatcattcagcaggtcggtagctttgcggaaaaaataacgcccggactccgttaactcaatgctgcgggtactgcgagtgaacagcaccacatccagccccgtctccatacgcttaatggtgtagctaatggcggaagtggttaaacccaactcttctgcggctttactgaagctgccaaaacgcgcagcggtagtaaatgccaacagattctcttcggtaaaaattgagttcattaaaccattctcgccattatctactatgaatttctccagctatgactgtagaggtatcggttaaagatagataatcatttttgaataacttttaatacccgtcgcgtttagtcgtcgcttcgcttaatttttgtccaccatattctgaaattacccccacgcagttacccgccagaaaacccagtaacgtcaccgtccagttcatcccgctggcaaaaaacagcgtcatgccgagaaagccaccgggaataaaggacagtaaccagaaacgcccttgccagaccactaccgccgagaagggtacggtagtaattacgctcgcccagaacgcggacagtccacttacagaggccagccaaccagcagtcagcgcggcgaaaaacgcccacaccatcccggaataattaaccgccagacttctgataaaccccgatttaccgccgcctgcggcataaaaactgcaaaaggcgacgaagccaatggttcctaataattcccatccttgagagagcccgacatgtgaagacactaactgccaaagccctgcacaaataccgacggtgacacccgttgccgtgagtccgttcatcttgttcccctctggttagacatggacgaaagctactcttacatgtgcagactatagagaaataaaacctgattgagtgaaagggtatcgggtcaaagaaacaaatattgcactaccgcacactgcgaaaagattgttgaatattattcaacaaaaaggcgagatacggcgaattaaatttaagcgggttcttttatcagattatcgttgctattctcaattcatcgaaaacagccacaaaaaccaggggaatgtgaatgagtataaaaaatctacctgccgactatttattggctgcacaacagggtgatatcgataaagtaaaaacctgccttgcgctgggtgtcgatattaatacctgcgatcgtcaggggaaaacggcaattacgctggcaagtttatatcagcaatatgcttgcgttcaggcattaattgatgccggagcggatattaataagcaagatcatacctgtttaaatccttttttaattagctgtctgaacgatgatttaacgctactacgaattattttaccggctaaacccgatcttaattgcgtaacccgttttggcggtgtcggcctgacgcctgcctgtgaaaaaggccatttaagtattgtaaaagagcttttggcgcatacggagattaacgttaaccagaccaaccatgtaggctggacgccgctactggaagcgattgtgcttaatgatggtggtattaaacagcaggcgattgtgcagttattgctggaacacggtgccagcccgcatctgaccgataaatatggcaaaacgccactggaactggcgcgggaacggggctttgaagagattgcgcagttactgattgccgcaggtgcataaaccgggaggcttgctatcaacacaccagaaagacggtgtgtgtgggcgctaactgcggatgcggattttctggcgcagcgggggcaaggacaggttgaacaggtctttgccagagcggtaaatatcgcactcccggctcgccagcagttgctgacgctgctttgtgaagagtacgacaatgcgccaaacagttgtcggttggcactcactcactttgatgatctgttccggcatggtgataaggttcagtttgacgatcaaggtattacggttggtcaacatcttcatatagagatgagtcgttgtcggcgttggctgtccccaaccttgcaaatgaccgctgtgaattttcaccttatcgcctggctacagtggcacgacattattcatcagcacctgggggaaaatgaaaccctgtttaattatcgcggcgataatccgttttatcaggcgttaaataaagaattacatattaaacgacgggcagttattcaggccgtaaacgataaacaaaatatcgcctcagcggtcgccagtatgatggggttagggattggccttacgccatcagccgacgattatttaacaggtctggcgcttattttatttattcccgggcatccggcggaaaaatacaaagaggaattttatctcggtctgcaacgcggcaaaaataataccacattattaagtgccataacgctggaagccgcattacaacaacgctgccgggaaaatattcatcgttttattcacaacattatttatgacatccctgggaacgcaactcaggcaatagaaaaaattaaacatattggctccagttccggctgcgacatgctgtatggcatggccgatggttgtgcgctgagccaaacctacggagggaattatgtcagttaaaatagtcattaaaccgaatacctattttgattctgtctcgctgatgtctatctccacgcgtgcaaataaactcgacggcgtcgagcaggcatttgtggcgatggcgaccgaaatgaataaaggcgtgctgaagaatttaggactgctgacgccggagctggagcaggcgaaaaacggcgacctgatgattgtcatcaatggtaaatcgggtgcggacaacgagcagttactggtggagattgaagaactgttcaacaccaaagcgcaaagcggctcgcacgaggcgcgttacgccactattggcagcgccaaaaagcatatcccggaaagtaacctggcggtgatttcggtcaacggtctgtttgccgctcgcgaagcgcgtcaggcgctgcaaaacgatctcaacgtgatgctgttttccgataacgtctcagttgaagatgaactggcgctcaagcaactggcccacgaaaaagggctgctgatgatggggccagactgtggcacggcgattatcaacggcgcggcgctctgttttggtaacgccgtgcgtcgcggcaacatcggtattgttggcgcatccggcaccggcagtcaggagttgagcgtccgcattcatgaatttggcggcggcgtttcgcaactgattggcaccggcgggcgcgacctgagcgagaaaatcggcggcctgatgatgctcgacgccatcgggatgctggaaaacgatccgcaaactgaaatcattgcgcttatctccaaaccgcctgcgcctgcggtggcccgcaaagtgctggaacgtgcgcgcgcctgccgcaagccggtggtcgtctgcttcctcgatcgtggcgaaacgccagtggatgagcaggggctacagtttgcccgcggcaccaaagaggcagcgctaaaagcggtgatgctctccggcgtgaaacaggaaaatctcgacctgcatacgcttaaccagccgttgattgcggatgtgcgtgcgcgtctgcaaccgcagcagaaatacattcgtggcctgttctgcggcggcacgctgtgcgacgaaaccatgttcgcggtgatggaaaaacatggcgatgtctacagcaacattcagcccgatccggaattccgcctgaaagatatcaaccgcagcatcaaacacaccttcctcgactttggcgatgacgacttcaccaatggcaagccgcacccgatgattgaccccaccaaccgcatcagtcgcttgatcgaagaggcgcgcgatccagaagtggcggtgatcgtgatggattttgtgctcggatttggatcgcatgaagatccggtcggctccaccatcgagacgatcaaagaagcgaaagcgatcgccgctgccgaaggacgcgagttgatcattctcgcctatgtgctgggtaccgatcttgatacgccatcgttagaacaacaaagccagatgctgcttgatgccggagtgattctggcgagcagcagcaccaataccggattgctggcgcgtgaatttatctgcaaaggggaggaagcctgatgagccagtcactgtttagccaaccattgaacgttattaacgtcggcatcgccatgtttagcgatgacctgaaaaagcagcatgtagaagtgactcaactcgactggacgccgccggggcagggcaatatgcaggtggtgcaggcgctggataacattgccgattcgccgctggcggacaaaatcgccgccgctaaccagcaggcgctggagcgtattatccagtcgcatccggtgctgattggttttgatcaggcgattaacgtggtgccgggcatgacggcgaaaaccattcttcacgccgggccgccgatcacctgggaaaaaatgtgcggcgcgatgaaaggcgcggtcaccggagcgctggtgttcgaaggactggcgaaagatctcgacgaggcggctgaactggcggcttccggggagatcaccttctcgccgtgtcacgagcacgactgcgtgggatcgatggcgggtgttacctcggcctcgatgtttatgcacatcgtaaaaaacaaaacctacggcaacatcgcttataccaacatgagcgagcagatggcgaagattttgcgtatgggcgctaacgaccagagcgtgattgaccgcctgaactggatgcgtgatgtgcagggaccaatactgcgcgacgcgatgaaaattatcggcgaaatcgatctgcgcttaatgctggcgcaggcgctgcatatgggcgatgagtgccataaccgcaataacgccgggacgacactgctgattcaggcgctgacgccggggattattcaggcgggttattccgtcgagcaacagcgcgaagtgtttgagtttgtcgccagcagcgactacttctccggcccgacgtggatggcgatgtgtaaagcggcgatggatgcggcgcatggcatcgaatacagcaccgtggtcaccaccatggcgcgtaacggcgtcgagttcggcctgcgggtcagcggcctgccggggcaatggtttaccggcccggcgcagcaggtgatcggcccgatgtttgccggttataagccggaagattcggggctggatatcggcgacagcgccatcaccgaaacctacggtattggcggatttgctatggcgaccgcgcccgctatcgtcgcgctggtgggcggcacggtggaagaagctattgatttctcccgtcagatgcgcgaaatcaccctcggtgaaaaccccaacgtcaccattccgctgctcggttttatgggcgtgccgtcggcaatcgacatcacccgcgtgggtagcagcggcattctgccggtgatcaacaccgccatcgcccataaagatgcgggcgtcggcatgattggcgcgggcattgtgcatccaccttttgcctgcttcgagaaagccattcttggctggtgcgaacgttacggcgtctgacctacatgttcatgccggatgcggcgtgaacgccttatccggcctacgaatggcgcaagaatctgtaggcctgataagcgtagcgcatcaggcatttgtcaccattgccggatgcggcgtgaacgccttatccggcctacgaatggcgcaagaatctgtaggcctgataagcgtagcgcatcaggcatttgccaccactgccggatgcggcgtggacgccttatccggcctacgagtggcgcgagaatctgtaggcctgataagcgtagcgcatcaggcatttgtcaccattgccggatgcggcgtgaacgccttatccggcctacgagtggcgcgagaattgtaggcctgataagcgtagcgcatcaggcagtctggcgttggtcataaccccatcaccctctgtagcggacataacaacatgaaagagcttgtggtcgttgccattggtggcaacagcattatcaaagataacgccagccagtcgattgagcatcaggcggaggcggtgaaagccgtcgccgatacggtgctggaaatgctggcttccgattacgacattgtgctgacccacggcaacgggccgcaggtcgggctggatttacgccgtgcggagattgcccacaagcgcgaagggctgcccttaacgccgctggcgaactgtgtggcagatacgcagggcggcatcggctatctgatccaacaggcgctgaataaccggctggcgcgtcacggcgagaagaaagccgtcaccgtggtgactcaggtggaagtggataaaaacgatccaggttttgcccatcccaccaagcccatcggcgcattctttagtgacagccagcgtgacgaattacaaaaggcaaaccctgactggtgttttgttgaagatgccgggcggggctatcgccgcgtggtcgcctcgccggaaccgaaacgtattgtcgaagcacctgccattaaagcgctgatccaacaaggttttgtcgtaattggcgcgggcggcggtggaattccggtagtgcgtactgacgcgggagattaccaaagcgtggacgcggttatcgacaaagatctctctaccgcgctgctggcccgtgaaattcacgccgacattcttgtgatcaccactggcgtcgaaaaagtgtgtattcactttggcaaaccgcagcagcaggcgctcgatcgggtggatattgccaccatgacccgctatatgcaggaagggcatttcccgcccggcagcatgttgccaaaaatcatcgccagcctgacatttttagaacaaggcggcaaagaagtgattatcaccacgccggaatgcctgcctgcggcgctgcgcggcgaaacgggcactcatattattaaaacgtaaggacgtaagatgaaagaaagcaatagccgccgtgaatttctgagccagagcggtaagatggtcaccgccgccgcgctgtttggtacctctgtgccgctcgcccatgcggcggtagctggcaccctaaactgcgaagcgaacaacaccatgaaaatcactgacccgcattactatctcgataacgtgctgctggaaaccggttttgactacgaaaatggcgtggcggtgcagacccgcacggcgcgccagaccgtggagattcaggacggcaaaattgtcgccctgcgcgagaacaagctgcatccggacgccacgctgccgcactatgacgctggcggtaagctgatgctgcccaccacccgcgacatgcatattcatctcgacaaaaccttttacggcgggccgtggcgctcgctcaatcgtccggcaggcaccaccatccaggacatgatcaaactcgagcagaaaatgctgccggaactgcaaccgtacactcaggagcgggcagaaaaactgattgatttattgcagtcgaaaggcaccaccattgcccgcagccactgcaatatcgaaccggtttccggcctgaaaaatctgcaaaatttgcaggcggtgctggcgcgacgtcaggcgggctttgagtgtgaaatcgtcgccttcccgcagcacggtttgctgctgtcgaaatctgaacctttaatgcgtgaagcgatgcaggcgggggcgcattacgtcggcggcctggacccgaccagtgttgatggcgcgatggaaaaatccctcgacaccatgttccagattgcgctggactacgacaaaggcgtcgatattcacctgcacgaaaccactccggcaggcgtggcagccatcaattatatggttgaaacggtagagaaaacgccacagctgaagggcaagctgaccatcagtcacgcctttgcgctggcaacgctcaacgagcaacaggtagatgaactggcgaaccggatggtggtgcaacaaatttctatcgcctcgacggtgccgattggcacgctgcatatgccgctcaaacagttgcacgacaaaggcgtaaaagtgatgactggcactgacagcgttatcgaccactggtcgccttatggtctgggcgacatgctggaaaaagccaatctgtacgcgcagctctatattcgtcctaacgaacagaacctctcccgctcgctgtttttagccactggcgatgtattgccgctgaatgaaaaaggcgagcgtgtatggccaaaagcgcaggatgacgccagctttgtgctggtggacgcctcctgttccgccgaggcggtggcgcgtatctcgccgagaaccgcaacgttccataaagggcaactggtgtgggggagtgtggcaggttgatgcgcatttgaaacgcctgcaacggtgaatagtaagagatttaagccccagggagtggggcaatctgaatatgagtgtgtcggcagaaatggacattatctttgaggaatatgcccttattgacgttgtgtagataactatttgtctacgtgaaaagatcatcagttttgccgattttagtcttttacagatagcaaatatcacacttacaggcgctcgccttatggggaacgttgctgctctgtttcattcaggctcgcggcatgttggggctggatcgggtggtttaaatattggctatattcaatggacgcgttttgccgcgatgacatatcaggcgttgccaaatacacatagctaatcaggagtaaacacaatgaagatcaaagctgttggtgcatattccgctaaacaaccacttgaaccgatggatatcacccggcgtgaaccgggaccgaatgatgtcaaaatcgaaatcgcttactgtggcgtttgccattccgatctccaccaggtccgttccgagtgggcggggacggtttacccctgcgtgccgggtcatgaaattgtggggcgtgtggtagccgttggtgatcaggtagaaaaatatgcgccgggcgatctggtcggtgtcggctgcattgtcgacagttgtaaacattgcgaagagtgtgaagacgggttggaaaactactgtgatcacatgaccggcacctataactcgccgacgccggacgaaccgggccatactctgggcggctactcacaacagatcgtcgttcatgagcgatatgttctgcgtattcgtcacccgcaagagcagctggcggcggtggctcctttgttgtgtgcagggatcaccacgtattcgccgctacgtcactggcaggccgggccgggtaaaaaagtgggcgtggtcggcatcggcggtctgggacatatggggattaagctggcccacgcgatgggggcacatgtggtggcatttaccacttctgaggcaaaacgcgaagcggcaaaagccctgggggccgatgaagttgttaactcacgcaatgccgatgagatggcggctcatctgaagagtttcgatttcattttgaatacagtagctgcgccacataatctcgacgattttaccaccttgctgaagcgtgatggcaccatgacgctggttggtgcgcctgcgacaccgcataaatcgccggaagttttcaacctgatcatgaaacgccgtgcgatagccggttctatgattggcggcattccagaaactcaggagatgctcgatttttgcgccgaacatggcatcgtggctgatatagagatgattcgggccgatcaaattaatgaagcctatgagcgaatgctgcgcggtgatgtgaaatatcgttttgttatcgataatcgcacactaacagactgaaaaaattaataaataccctgtggtttaacatattaacttcgctctccacttaactttttagttaaggagagcgaaataatatcaaagtagcagtaaaacctataacgtaaatttaaattgttaaattaacgccctccagtacacaatacttcacacgttagttatgagcgatttctgatagtgcctggtttaatcagagctttattatctgcgacgtttatttttatttaagagagatcgcgatgatatcattaaaagctccgcacaataatttgatgccatatacgcaacaaagcatacttaatacggttaaaaacaatcagttaccagaggatatcaaaagctccctggtttcctgtgtcgatatattcaaggttttgattaaacaatattatgattatccttatgattgtcgtgatgatttagtcgatgacgacaaactcattcatctcatggctgccgtacgagactgtgagtggtcagacgataacgcactcaccataaatgtgcagtttaatgatttccctggattttatgactggatggattaccctgatcacccggttaagtttgtttttcacatacttgaaaatcaaaaagggacagtttgggtatatgaccaggatgatgcgtttcttgatattaaagcaaacgtgcaggctggacgctttaccgggcttaagaaattagtgcagtttatcgattcagtgcgaacagattgcaaatgtattcttcttgaataccatatgcctttgctgagaattttccctaaagggaaagagtgtatgcatgtggaaaaatggcttcgcgaaatgtcgtctattccggagacagacgcgcccattaagcaggcgcttgcgcatggattattattacacttaaaaaatatctaccctgtttttcctgaatcactggtgatgttattgctctctgttctggacgtaaaaacatacagagatgatgcgcgattaaatgaatggatatctaatagagtgcaggaattaggtgacagatattatcctgtaaataagcacgttaaaatccgctacactctttagttcagaaagggttccacctgcaagttgttattccacctgagagtgaatcgcaatgcaggtaatcatttcatctgtatatctgtatgccaactggcattccatctcttttttcgccgatattttgttgtgatcggcgacacttcgcttaaaaaagcaccagtagtggtttcgcagccatgcggtgtataaaaaatgatctcatgcagatgttttgtgaatgtgttggttgacattcatatgaaaaaaatcataattccatcatgtttgtgtggggtcttttctgtatcttacgcatcgcactcaagcctgacagaaaatatgctgtaaggctcatatcaaaaaccgccattagctcatcaggaagagcagacgacaaccaggattgttgtatggtacggggttcgaggcctcgatggcggtccaacttttcaaaactcttctgaatcagatccccttattatcatccctgcaaagtggaacattgccattgtttggctattcaggatggggcagaccaatgaaaaaagcccacacaggggagagtgggctgaaatgggaagctaaagactcaagtaaacttatcggaaataaggaccacgcattacgggggctatcatcgccgatggccgtgattcggcaaatcaggttgattacgtagagagtaaattatctgctcaccgctgcgtcaccccttcgtaaatcaggcgtagcgcgaatacaccaataattgcaccaataacccgactggcaacgcgttgcatacgcccataagcacgacgcacagcgggcaaagaaaacgcctgactaagaaaaactcgccagataattgatgcgagcacaatccccgcccaggccattaaacgtgcccatgttggtgtttcggcatttaatgttactgagaaaatactgataaaaaataaaacggtttgcgggttagagagatcggtaattaatccgcggcgaaaaaagacataccagggggcgctaatcggttgttgtagtgtgctcatttgcggtgttgactggcggcgcatgctgcaccacgcaaaccataagagataagcgccgccgacgattctgataagcgaaaaaatctcctcacactgcgtaattagcgttgcaagaccaaacaaacccaacccggaataaaatgcatcgcccagcgccacgcccagcccggtcagcacccctgcgcgtcgaccggaagccaggctggtttgtactaccacaaagagattggctcccggattaaaaaaagtaatcacgaacagtcctacggtcaggtaaacggcatgcaaaggatccatagtgatttcatccataaataagtgaactaactgcatcatatttctaccaaaaataatcgggtgcgagagagatcacaaagtgtcttatttccggttactggcgtttatgccctgactgaactaattattaatcaacccaataatgtgggtgggtgatagtgtgataacaactctggagccgtaatatgaaaataatctctaaaatgttagtcggtgcgttagcgttagccgttaccaatgtctatgccgctgaattgatgaccaaagcggaatttgaaaaagttgaatcgcagtatgaaaaaataggtgatatttcaaccagcaatgaaatgtcgactgcagatgcaaaagaagatttgatcaaaaaagcggatgaaaaaggggctgatgtgttggtactgacctccggtcaaactgacaataagatccacggcacggcaaatatttataagaagaagtaattctgaatcctatgtaaacatctccgatgcgtaagtttatcggtgatcatctattgaaatttatgccggataaagcgttcgcgctgcattcggcagttcagcttttcagccgccgccagaacgtcgtccggctgatgcctaaataattcgccgctgctgttttatcgccattaaatttctccagtgcctgttgtggtgtcagtaagcgtggagcgggagttttcgccgactcgcgcgccagttccggcagtagcagttgcataaactgcggcgttaaatccggcgtcggttccacacttaaaaacagcgccagtcgttccatcatattgcgcagttcacgaatattgcctggccagtcgtagtgcagcagcacagtttcacttgcctgtaacccctggcgtaatgcagcagaaaatggggcggagagcgccgccagagacactttcaaaaagctttccgccagcggaagaatatccgccacccgctcgcgcagtggtggcaattgcagacgcaaaatactcagccgataaaacagatcacggcgaaaacgtccttgctgcatatcttcttccagattgcagtgagtggcgctaatgacccgtacatctaccggaacaggctgatgcccgccgacgcgggtgacctctttttcttccagcacccgcagcagccgggtctgcaaaggtagcggcatttcgccaatctcatccagaaacagcgtaccgccgtgggcaatttcgaacagcccggcgcgacctccgcgtcgcgagccggtaaacgccccttcctcatagccaaacagttctgcttccagcagcgattcggcaatcgccccgcagttgacggcaacaaacggatgcgactttttgccctgtcgcgcatcgtggcgggcaaaatattcccgatgaatcgcctgggccgccagctctttgcccgtccccgtttccccctcaatcaacaccgccgcactggagcgggcatacagcaaaatagtctgccgtacttgttccatctgtggtgattgaccgagcatatcgcccagcacgtaacgagtacgcagggcgttgcgggtggcatcgtgagtgttatggcgtaacgacatgcgcgtcatatccagcgcatcgctgaacgcctggcgcacggtggcggcggaatagataaaaattccggtcattccggcttcttctgccaaatcggtaatcagccctgcgccgaccaccgcttcggtgccgttagcttttagctcgttaatctgcccgcgtgcgtcttcctcggtaatgtagctacgttggtcgaggcgcaaattaaaggttttttgaaacgccaccagcgctggaatggtttcctgataggtgacaacgccgatagaagaggtgagttttccggcttttgccagtgcctgtaacacatcgtagccgctcggtttaatcaaaataactggcactgacaggcggcttttcaggtacgcgccgttagagccagccgcgatgatggcgtcacagcgttcgtttgccagtttcttgcggatgtaggtcactgctttttcaaagccaagctgaataggggtaatgttcgccaggtgatcaaactcgaggctgatatcgcgaaacagctcgaacaggcgcgttacagataccgtccagataaccggtttgtcgtcattaagccgtggtggatgtgccatagcgcaccgcaaagttaagaaaccgaatattgggtttagtcttgtttcataattgttgcaatgaaacgcggtgaaacattgcctgaaacgttaactgaaacgcatatttgcggattagttcatgactttatctctaacaaattgaaattaaacatttaattttattaaggcaattgtggcacaccccttgctttgtctttatcaacgcaaataacaagttgataacaaaggatgggctatgtctctacactctccaggtaaagcgtttcgcgctgcactgactaaagaaaatccattgcagattgttggcaccatcaacgctaatcatgcgctgttggcgcagcgtgccggatatcaggcaatttatctttctggcggtggcgtggcggcaggttcgctggggctgcccgatctcggtatttctacccttgatgatgtgctgaccgacattcgccgtatcaccgacgtttgttcgctgccgctgctggtggatgcggatatcggttttggttcttcggcctttaacgtggcgcgcaccgtgaaatcgatgattaaagccggtgcggcaggattgcatattgaagatcaggttggtgcgaaacgctgcggtcatcgtccgaataaagcgatcgtctcgaaagaagagatggtggatcggatccgcgcggcggtggatgcgaaaaccgatcctgattttgtgatcatggcgcgcaccgatgctctggcggtagaggggctggatgcggcgatcgagcgtgcgcaggcctatgttgaagcgggtgccgagatgttgttcccggaggcgattaccgaactcgccatgtaccgccagtttgccgatgcggtgcaggtgccgatcctcgccaacatcaccgaatttggtgccacgccgctgtttaccaccgacgaattacgcagcgcccatgtcgcaatggcgctgtacccactttcagcgttccgcgccatgaaccgcgccgctgaacatgtctacaacgtcctgcgccaggaaggcacgcagaaaagcgtcatcgacaccatgcagacccgcaacgagctgtacgaaagcatcaactactaccagtacgaagagaagctcgacaacctgtttgcccgtagccaggtgaaataaaaaacgcccgttgattgtattcgacagccgatgcctgatgcgtcgctgacgcgacttatcaggcctacgaggtgcactgaactgtaggtcggataagacggatggcgtcgcatccgacaaccgatgcctgatgcgccgctgacgtgacttatcaggcctacggggtgcactgaactgtaggtcggataagacgcatagcgtcgcatccgacaaccgatgcctgatgcgccgctgacgcgacttatcaggcctacggggtgcactgaactgtaggtcggataagacgcatagcgtcgcatccgacaaccgatgcctgatgcgccgctgacgcgacttatcaggcctacggggtgaactgaactgtaggtcggataagacgcatagcgtcgcatccgacaacaatctcgaccctacaaatgataacaatgacgaggacaacatgagcgacacaacgatcctgcaaaacagtacccatgtcattaaaccgaaaaaatctgtggcactttctggcgttccggcgggcaatacggcgctctgcaccgtgggtaaaagtggcaatgacctgcattaccgcggctacgatattcttgatctggcgaaacattgcgaatttgaagaagtggcgcatctgctgatccacggcaaactgccgacccgtgacgaactcgccgcttacaaaacgaaactgaaagccctgcgcggtttaccggctaacgtgcgtaccgtgctggaagccttaccggcggcgtcgcacccgatggatgttatgcgcaccggtgtttccgcgctcggctgcacgctgccagaaaaagaggggcataccgtctctggcgcgcgggatattgccgacaaactgctggcgtcgcttagctcgattctcctttattggtatcactacagccacaacggcgaacgcatccaaccggaaaccgatgacgactccatcggcggtcacttcctgcatctgctgcacggcgaaaagccatcgcaaagctgggaaaaggcgatgcatatctcgctggtgctgtacgccgaacacgagtttaacgcctccacctttaccagtcgggtgattgcgggcaccggctctgatatgtattccgcgattattggcgcgattggcgcactgcgcgggccaaaacacggcggggcgaatgaagtgtcgctggagatccagcaacgctacgaaacgccggacgaagccgaagcagatatccgcaagcgcgtggaaaacaaagaagtggtcattggttttggtcatccggtttacaccatcgctgacccgcgccaccaggtgattaaacgtgtggcgaagcagctctcgcaggaaggcggctcgctgaagatgtacaacatcgccgatcgcctggaaacggtgatgtgggagagcaaaaagatgttccccaatctcgactggttctctgctgtttcctacaacatgatgggcgttcccaccgagatgttcacaccactgtttgttatcgcccgcgtcaccggctgggcggcgcacattatcgaacaacgtcaggacaacaaaattatccgtccttccgccaattatgttggaccggaagaccgcccgtttgtcgcgctggataagcgccagtaaacctctacgaataacaataaggaaacgtacccaatgtcagctcaaatcaacaacatccgcccggaatttgatcgtgaaatcgttgatatcgtcgattacgtcatgaactacgaaatcagctctaaagtggcctacgacaccgcacattactgcctgctcgacacgctcggctgcggtctggaagctctcgaatacccggcctgtaaaaaactgctggggccaattgttcccggcaccgtcgtacccaacggcgtgcgcgtccccggaactcagttccagctcgaccccgtccaggcggcatttaacatcggcgcgatgatccgctggctcgatttcaacgatacctggctggcggcggagtggggccatccttccgacaacctcggcggcattctggcaacggcggactggctttcgcgcaacgcggtcgccagcggcaaagcgccgttgaccatgaaacaggtgctgaccgcaatgatcaaagcccatgaaattcagggctgcatcgcgctggaaaactcctttaaccgcgtcggcctcgaccacgttctgttagtgaaagtggcttccaccgccgtggtcgccgaaatgctcggcctgacccgcgaggaaattctcaacgccgtttcgctggcgtgggtggacggtcagtcgctgcgcacctatcgccatgcgccgaacaccggcacgcgtaaatcctgggcggcgggcgatgccacttcccgcgcggtacgtctggcactgatggcgaaaacgggcgaaatgggttacccgtcagccctgactgcgccggtgtggggcttctacgacgtctcctttaaaggtgaatcgttccgcttccagcgcccgtacggttcctacgttatggaaaatgtgctgttcaaaatctccttcccggcggagttccactcccagacggcagttgaagcagcgatgacgctctatgaacagatgcaggcagcaggcaaaacggcggcggatatcgaaaaagtgaccattcgcacccacgaagcctgtattcgcatcatcgacaaaaaagggccgctcaataacccggcagaccgcgatcactgcattcagtacatggtggcgatcccgctgctattcgggcgcttaacggcggcagattacgaggacaacgttgcgcaagataaacgcattgacgccctgcgcgagaagatcaattgctttgaagatccggcatttaccgctgactaccacgacccggaaaaacgcgccatcgccaatgccattacccttgagttcaccgacggcacacgatttgaagaagtggtggtggagtaccccattggtcatgctcgccgccgtcaggatggtattccgaaactggtcgataaattcaaaatcaatctcgcgcgccagttcccgactcgccaacagcagcgcattctggaggtttctctcgacagagctcgcctggaacagatgccggtcaatgagtatctcgacctgtacgtcatttaagtaaacggcggtaaggcgtaagttcaacaggagagcattatgtcttttagcgaattttatcagcgttcgattaacgaaccggagcagttctgggccgagcaggcccggcgtattgactggcagacgccctttacgcaaacgctcgatcacagcaatccgccgtttgcccgttggttttgtgaaggccgaaccaacttgtgccacaacgccatcgaccgctggctggagaaacagccagaggcgctggcgctgattgccgtctcttcggaaacagaagaagagcgcacctttacctttcgtcagctgcatgacgaagtgaacgcggtggcctcaatgttgcgttcattgggtgtgcagcgcggcgatcgggtgctggtgtatatgccgatgattgccgaagcgcatattactctgctggcctgcgcgcgcattggcgctattcactcggtggtgtttggtggatttgcctcgcacagcgtggcggcgcgaattgatgacgctaaaccggtgctgattgtctcggctgatgccggagcgcgcggtggcaaaatcattccctataaaaaattgctcgacgatgcgataagtcaggcgcagcaccagccacgccatgttttgctggtggatcgcgggctggcgaaaatggcgcgcgtcagcgggcgggatgtcgatttcgcgtcgttgcgccatcaacacatcggcgcgcgggtaccggtggcgtggctggaatccaacgaaacctcctgcattctctacacttccggcacgaccggcaaacctaaaggcgtgcagcgtgacgtcggcggatatgcggtggcgctggcgacctcgatggacaccatttttggcggcaaagcgggcagcgtgttcttttgcgcatcggatatcggctgggtggtggggcattcgtatatcgtttacgcgccgctgctggcggggatggcgactatcgtttacgaaggattgccgacctggccggactgcggcgtgtggtggacaatcgtcgagaaatatcaggttagccggatgttctcagcgccgaccgccattcgcgtgctgaaaaaattccctaccgctgaaattcgcaaacacgatctctcgtcgctggaagtgctctatctggctggagaaccgctggacgagccgaccgccagttgggtgagcaatacgctggatgtgccggtcatcgacaactactggcagaccgaatccggctggccgattatggcgattgctcgcggtctggacgacaggccgacgcgtctgggaagccccggtgtgccgatgtatggctataacgtgcagttgcttaatgaagtcaccggcgaaccgtgtggcgtcaacgagaaagggatgctggtggtggaagggccgctgccgccggggtgtattcagaccatctggggcgacgacggccgctttgtgaagacttactggtcgctgttttcccgcccggtgtacgccacctttgactggggcatccgtgacgctgacggttatcactttattctcgggcgcactgacgatgtaattaacgttgccgggcatcggctggggacgcgcgagattgaagagagtatctccagccatccgggcgttgccgaagtggcggtggttggggtgaaagatgcgctgaaagggcaggtggcggtggcgtttgtcattccgaaagagagcgacagtctggaagatcgtgatgtggcgcactcgcaagagaaggcgattatggcgctggtggacagccagattggcaactttggccgcccggcgcacgtctggtttgtctcgcaattgccaaaaacgcgatccggaaaaatgctgcgccgcacgatccaggcgatttgcgaaggacgcgatcctggagatctgacgaccattgatgatcctgcgtcgttggatcagatccgccaggcgatggaagagtaggttattgtcggatgcgtcgcgcggtgcatccggcactgtgtgccgatgcctgatgcgacgctgacgcgttttatcatgcctacggacctgaaccgtaggtcggataaggcgctcgcgtcgcatccgacaccatgctcagatgcctgatgcgacgctgacgcgtcttatcaggcctacccactgtttttacaccgataatttttcccccacctttttgcactcattcatataaaaaatatatttccccacgaaaacgattgctttttatcttcagatgaatagaatgcggcggattttttgggtttcaaacagcaaaaagggggaatttcgtgtcgcaagataacaactttagccaggggccagtcccgcagtcggcgcggaaaggggtattggcattgacgttcgtcatgctgggattaaccttcttttccgccagtatgtggaccggcggcactctcggaaccggtcttagctatcatgatttcttcctcgcagttctcatcggtaatcttctcctcggtatttacacttcatttctcggttacattggcgcaaaaaccggcctgaccactcatcttcttgctcgcttctcgtttggtgttaaaggctcatggctgccttcactgctactgggcggaactcaggttggctggtttggcgtcggtgtggcgatgtttgccattccggtgggtaaggcaaccgggctggatattaatttgctgattgccgtttccggtttactgatgaccgtcaccgtcttttttggcatttcggcgctgacggttctttcggtgattgcggttccggctatcgcctgcctgggcggttattccgtgtggctggctgttaacggcatgggcggcctggacgcattaaaagcggtcgttcccgcacaaccgttagatttcaatgtcgcgctggcgctggttgtggggtcatttatcagtgcgggtacgctcaccgctgactttgtccggtttggtcgcaatgccaaactggcggtgctggtggcgatggtggcctttttcctcggcaactcgttgatgtttattttcggtgcagcgggcgctgcggcactgggcatggcggatatctctgatgtgatgattgctcagggcctgctgctgcctgcgattgtggtgctggggctgaatatctggaccaccaacgataacgcactctatgcgtcgggtttaggtttcgccaacattaccgggatgtcgagcaaaaccctttcggtaatcaacggtattatcggtacggtctgcgcattatggctgtataacaattttgtcggctggttgaccttcctttcggcagctattcctccagtgggtggcgtgatcatcgccgactatctgatgaaccgtcgccgctatgagcactttgcgaccacgcgtatgatgagtgtcaattgggtggcgattctggcggtcgccttggggattgctgcaggccactggttaccgggaattgttccggtcaacgcggtattaggtggcgcgctgagctatctgatccttaacccgattttgaatcgtaaaacgacagcagcaatgacgcatgtggaggctaacagtgtcgaataacgctttacaaacaattattaacgcccggttaccaggcgaagaggggctgtggcagattcatctgcaggacggaaaaatcagcgccattgatgcgcaatccggcgtgatgcccataactgaaaacagcctggatgccgaacaaggtttagttataccgccgtttgtggagccacatattcacctggacaccacgcaaaccgccggacaaccgaactggaatcagtccggcacgctgtttgaaggcattgaacgctgggccgagcgcaaagcgttattaacccatgacgatgtgaaacaacgcgcatggcaaacgctgaaatggcagattgccaacggcattcagcatgtgcgtacccatgtcgatgtttcggatgcaacgctaactgcgctgaaagcaatgctggaagtgaagcaggaagtcgcgccgtggattgatctgcaaatcgtcgccttccctcaggaagggattttgtcgtatcccaacggtgaagcgttgctggaagaggcgttacgcttaggggcagatgtagtgggggcgattccgcattttgaatttacccgtgaatacggcgtggagtcgctgcataaaaccttcgccctggcgcaaaaatacgaccgtctcatcgacgttcactgtgatgagatcgatgacgagcagtcgcgctttgtcgaaaccgttgctgccctggcgcaccatgaaggcatgggcgcgcgagtcaccgccagccacaccacggcaatgcactcctataacggggcgtatacctcacgcctgttccgcttgctgaaaatgtccggtattaactttgtcgccaacccgctggtcaatattcatctgcaaggacgtttcgatacgtatccaaaacgtcgcggcatcacgcgcgttaaagagatgctggagtccggcattaacgtctgctttggtcacgatgatgtcttcgatccgtggtatccgctgggaacggcgaatatgctgcaagtgctgcatatggggctgcatgtttgccagttgatgggctacgggcagattaacgatggcctgaatttaatcacccaccacagcgcaaggacgttgaatttgcaggattacggcattgccgccggaaacagcgccaacctgattatcctgccggctgaaaatgggtttgatgcgctgcgccgtcaggttccggtacgttattcggtacgtggcggcaaggtgattgccagcacacaaccggcacaaaccaccgtatatctggagcagccagaagccatcgattacaaacgttgaacgactgggttacagcgagcttagtttatgccggatgcggcgtgaacgccttatccggcctacgtagagcactgaactcgtaggcctgataagcgtagcgcatcaggcaattccagccgctgatctgtgtcagcggctaccgtgattcattcccgccaacaaccgcgcattcctccaacgccatgtgcaaaaatgccttcgcagcggctgtctgccagctgtagtttatgccggatgcggcgtgaacgccttatccggcctacgtagagcactgaactcgtaggcctgataagcgtagcgcatcaggcaattccagccgcagacctgtgtcagcggctaccgtgattcatttccgccaacaaccgcgcatttatccaacgccatgtgcaaaaatgccttcgcggcggctgtctgccagctatttttccgccgcaacaaaaccgccgttctctccagtagtggcggggcaagagaaatagctttaagcccgtcatgttgtgtggcaatcgctgctggtaacaatgtggaaagggaagtgcggcgaatcagctccagaaccgcgctaattgagttcgcctcaatgaccacctgtggatgtagccccgctttctcgcagtagtggtcaatttgctctctggtggcaaattccgcgctgagcaggaccagtttttcatcatgcaagcgactcaacgccacctgttcatggacggccagcggatgatgttgcgccacgactaacgctaaactttctgtcagtaaaggaattgcctccagctccggcgaatgcacaggcgcgaaggcaatcccaacgtccaactcgtcgcggcaaagcatatcctcgattttctcctgcgacatttcctgtagctggagcgtgatgctgggatagcgcgcatagaaatccgccattaaggggccgataaagtagctcgtaaaggtgggggtgacggcgatacgcagcgatcctcgcgtcagatcggcaacatcatgaatcgcccgtttacccgcccccagttcctgtaacgcccggctggcgtactgtcgccagacttctcctgcatcagtgagacgaatcgttcgcccgctacggtcaaacagcggcacgcctaaactctcctctaactggcgaatctgctgggaaagcgcaggttgggagacgtgcaacgcactggcggcacgggtgaagctgccatgttcagccacggcaagaaaataattgatatgtcgagagagcattcgcaacctataagtaaatccaatggaactcatcataaatgagacttttaccttatgacaatcggcgagtagtctgcctctcattccagagacagacagaggttaacggtgaaagagattattgatggattccttaaattccagcgcgaggcatttccgaagcgggaagccttgtttaaacagctggcgacacagcaaagcccgcgcacactttttatctcctgctccgacagccgtctggtccctgagctggtgacgcaacgtgagcctggcgatctgttcgttattcgcaacgcgggcaatatcgtcccttcctacgggccggaacccggtggcgtttctgcttcggtggagtatgccgtcgctgcgcttcgggtatctgacattgtgatttgtggtcattccaactgtggcgcgatgaccgccattgccagctgtcagtgcatggaccatatgcctgccgtctcccactggctgcgttatgccgattcagcccgcgtcgttaatgaggcgcgcccgcattccgatttaccgtcaaaagctgcggcgatggtacgtgaaaacgtcattgctcagttggctaatttgcaaactcatccatcggtgcgcctggcgctcgaagaggggcggatcgccctgcacggctgggtctacgacattgaaagcggcagcatcgcagcttttgacggcgcaacccgccagtttgtgccactggccgctaatcctcgcgtttgtgccataccgctacgccaaccgaccgcagcgtaaccttatttttaaaccatcaggagttccaccatgattcagtcacaaattaaccgcaatattcgtcttgatcttgccgatgccattttgctcagcaaagctaaaaaagatctctcatttgccgagattgccgacggcaccggtctggcagaagcctttgtaaccgcggctttgctgggtcagcaggcgcttcctgccgacgccgcccgcctggtcggggcgaagctggatctcgacgaagactccattctactgttgcagatgattccactgcgtggctgcattgatgaccgtattccaactgacccaacgatgtatcgtttctatgaaatgttgcaggtgtacggtacaaccctgaaagcgttggttcatgagaaatttggcgatggcattattagcgcgattaacttcaaactcgacgttaagaaagtggcggacccggaaggtggcgaacgtgcggtcatcaccttagatggtaaatatctgccgaccaaaccgttctgacagccatgcgcaaccatcaaaagacgttcacgatgctgctggtactggtgctgattggtcttaatatgcgaccactgctcacctccgtcgggccactgctaccgcaattgcgccaggcgagcggaatgagctttagcgtggctgccctgttgaccgctctgccggtggttaccatgggcgggctggcgctggccggaagctggcttcatcagcatgtcagcgaacgtcgcagtgtcgccatcagtctgttgctgattgccgtcggtgcattgatgcgtgagctttacccgcaaagtgcgctgctgcttagcagcgcactgcttggtggggtggggatcggcatcattcaggcggtgatgccttcggtgattaaacggcggtttcagcagcgcacgccactggtgatggggctgtggtccgcggctctgatgggcggcggtgggcttggtgccgccataacgccctggttagttcaacatagcgaaacctggtatcaaacactcgcctggtgggcgctgcctgccgttgttgcgctctttgcctggtggtggcaaagcgcccgcgaggtcgcctcttcccacaagacaacaaccactccggttcgcgtggtattcactccccgcgcgtggacgctgggtgtttacttcggtctgattaacggcggttacgccagcctgattgcctggttacccgctttctatattgagattggtgccagcgcgcagtacagcggttccttactggcattgatgacgcttgggcaagccgcaggagctttgctgatgcctgctatggctcgccatcaggatcggcgcaaactgttaatgctggcgctggtgttacaactggtggggttctgcggctttatctggctgccgatgcaattgccggtattgtgggcgatggtgtgtgggttaggtctgggcggcgcgtttccgctctgtttgctgctggcgctcgatcactctgtgcaaccggctattgctggcaagctggtggcgtttatgcagggaatcggttttatcatcgccgggcttgccccgtggttttctggcgtgctgcgtagtatcagcggcaattacctgatggactgggcatttcatgcgctgtgcgtcgttgggctgatgatcataaccctgcgttttgcaccagtacgttttccgcagctgtgggtcaaagaggcatgatgcgacgcttgttcctgcgctttgttcatgccggatgcggctaatgtagatcgctgaacttgtaggcctgataagcgcagcgtatcaggcaatttttataatttaaactgacgattcaactttataatctttgaaataatagtgcttatcccggtcgtttatttcgcgaataacccgacaaggaacgccagccgccacgacgtttggtggaatgtcttttgtgacgatactacccgcgccaataacagaattatccccgatggtgacgcctggattaataaccacatgacttccgatccagacgttattgccaatcgttatcggaaaagagtacatctcgccgttttttctcaattcatggtgtacagggtgtcccgtaacggaaagagtaacgttgggtgcaatcagtacgttatcaccgattgttaccgtgtagtcatcgacaatggttaaattgaaatttgcataaaaattgcggcctatatggatgttggaaccgtaagagaaatagacaggcggttctacccaggcgttttcccctaccgtggcaaacatttctttaatcaggctttctcttttttcaacttctgatggatgcgagtgattaaactcatacattaacgttttcccacgaagtcttttttccggtaagccttcgcacatatcggtaaatagcttgcctgctcttattctttcggtcattggcatgttcaatgcgatcactccgttatgatatgttggtcggataaggcgctcgcgccgcatccgacattgattgcttaagcgacttcattcacctgacgacgcagcagggaaagcgggccggggccgctaagcgtgaacacggaaattaaggtgaagcccagcgccaccagacccagcaccagataagcgccctggaaaccgatgctttcatacatattgcccgccagtacagacataaaaatcatcgccagttgcttaaagaagcagaaacagaccagataaatcgtcgctgaaaaacgcacttcaaactggctggtaatatatttaaagcagcccaccagcaggaacggtacttcaaacatatgcagcgttttcagaataaccacttccagcgctgaggtggcgaacgatgagccaataatacgtacagacataatagtgccagccagcagcagggcgtttttcccaccgatgcgattaatgatcagtggcgcaaagaacataatcgaggcgttaagtaattcgcccattgtcgttacgtagccaaatacccgcgtaccctgttcaccggtagcaaagaacgaagtaaagaaattagcaaactgttggtcaaaaacatcgtaggtgcaggaaacgccaataacatacagtgacaaaaaccacagttttggctgtctgaacagttccagtgccagcttaaggctaaatgccgaatggttggcacctaccgcattggcaaccgtggcagaagagggcgcatccgttttggcgaaaaagagtaaaacggcgaggatgagtgcacagccagagcccagccagaaaacaaactgattattgatggtgaacatgatgccgacaatcgaggcacacagcgcccagccaacacagccaaacatccgcgcgcgaccaaattcgaaattactgcgacggctgactttctcaataaatgcctctactgctggcgcaccggcgttaaaacaaaagcctagataaataccaccaacaatcgatcctactaaaatgttgtattgtaacagtggcccgaagataaaaataaagaacggcgcaaacatcactaacatgccggtaataatccacagcaggtatttgcgcagcccgagtttgtcagaaagcagaccaaacagcggttggaataatagcgagaacagagaaatagcggcaaaaataatacccgtatcacttttgctgatatggttgatgtcatgtagccaaatcgggaaaaacgggaagtaggctcccatgataaaaaagtaaaagaaaaagaataaaccgaacatccaaaagtttgtgttttttaaatagtacataatggatttccttacgcgaaatacgggcagacatggcctgcccggttattattatttttgacaccagaccaactggtaatggtagcgaccggcgctcagctggaattccgccgatactgacgggctccaggagtcgtcgccaccaatccccatatggaaaccgtcgatattcagccatgtgccttcttccgcgtgcagcagatggcgatggctggtttccatcagttgctgttgactgtagcggctgatgttgaactggaagtcgccgcgccactggtgtgggccataattcaattcgcgcgtcccgcagcgcagaccgttttcgctcgggaagacgtacggggtatacatgtctgacaatggcagatcccagcggtcaaaacaggcggcagtaaggcggtcgggatagttttcttgcggccctaatccgagccagtttacccgctctgctacctgcgccagctggcagttcaggccaatccgcgccggatgcggtgtatcgctcgccacttcaacatcaacggtaatcgccatttgaccactaccatcaatccggtaggttttccggctgataaataaggttttcccctgatgctgccacgcgtgagcggtcgtaatcagcaccgcatcagcaagtgtatctgccgtgcactgcaacaacgctgcttcggcctggtaatggcccgccgccttccagcgttcgacccaggcgttagggtcaatgcgggtcgcttcacttacgccaatgtcgttatccagcggtgcacgggtgaactgatcgcgcagcggcgtcagcagttgttttttatcgccaatccacatctgtgaaagaaagcctgactggcggttaaattgccaacgcttattacccagctcgatgcaaaaatccatttcgctggtggtcagatgcgggatggcgtgggacgcggcggggagcgtcacactgaggttttccgccagacgccactgctgccaggcgctgatgtgcccggcttctgaccatgcggtcgcgttcggttgcactacgcgtactgtgagccagagttgcccggcgctctccggctgcggtagttcaggcagttcaatcaactgtttaccttgtggagcgacatccagaggcacttcaccgcttgccagcggcttaccatccagcgccaccatccagtgcaggagctcgttatcgctatgacggaacaggtattcgctggtcacttcgatggtttgcccggataaacggaactggaaaaactgctgctggtgttttgcttccgtcagcgctggatgcggcgtgcggtcggcaaagaccagaccgttcatacagaactggcgatcgttcggcgtatcgccaaaatcaccgccgtaagccgaccacgggttgccgttttcatcatatttaatcagcgactgatccacccagtcccagacgaagccgccctgtaaacggggatactgacgaaacgcctgccagtatttagcgaaaccgccaagactgttacccatcgcgtgggcgtattcgcaaaggatcagcgggcgcgtctctccaggtagcgaaagccattttttgatggaccatttcggcacagccgggaagggctggtcttcatccacgcgcgcgtacatcgggcaaataatatcggtggccgtggtgtcggctccgccgccttcatactgcaccgggcgggaaggatcgacagatttgatccagcgatacagcgcgtcgtgattagcgccgtggcctgattcattccccagcgaccagatgatcacactcgggtgattacgatcgcgctgcaccattcgcgttacgcgttcgctcatcgccggtagccagcgcggatcatcggtcagacgattcattggcaccatgccgtgggtttcaatattggcttcatccaccacatacaggccgtagcggtcgcacagcgtgtaccacagcggatggttcggataatgcgaacagcgcacggcgttaaagttgttctgcttcatcagcaggatatcctgcaccatcgtctgctcatccatgacctgaccatgcagaggatgatgctcgtgacggttaacgcctcgaatcagcaacggcttgccgttcagcagcagcagaccattttcaatccgcacctcgcggaaaccgacatcgcaggcttctgcttcaatcagcgtgccgtcggcggtgtgcagttcaaccaccgcacgatagagattcgggatttcggcgctccacagtttcgggttttcgacgttcagacgtagtgtgacgcgatcggcataaccaccacgctcatcgataatttcaccgccgaaaggcgcggtgccgctggcgacctgcgtttcaccctgccataaagaaactgttacccgtaggtagtcacgcaactcgccgcacatctgaacttcagcctccagtacagcgcggctgaaatcatcattaaagcgagtggcaacatggaaatcgctgatttgtgtagtcggtttatgcagcaacgagacgtcacggaaaatgccgctcatccgccacatatcctgatcttccagataactgccgtcactccagcgcagcaccatcaccgcgaggcggttttctccggcgcgtaaaaatgcgctcaggtcaaattcagacggcaaacgactgtcctggccgtaaccgacccagcgcccgttgcaccacagatgaaacgccgagttaacgccatcaaaaataattcgcgtctggccttcctgtagccagctttcatcaacattaaatgtgagcgagtaacaacccgtcggattctccgtgggaacaaacggcggattgaccgtaatgggataggtcacgttggtgtagatgggcgcatcgtaaccgtgcatctgccagtttgaggggacgacgacagtatcggcctcaggaagatcgcactccagccagctttccggcaccgcttctggtgccggaaaccaggcaaagcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaatccgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtcaacgtaaatgcatgccgcttcgccttccggccaccagaatagcctgcgattcaaccccttcttcgatctgttttgctacccgttgtagcgccggaagatgcttttccgctgcctgttcaatggtcattgcgctcgccatatacaccagattcagacagccaatcacccgttgttcactgcgcagcggtacggcgatagaggcgatcttctcctcctgatcccagccgcggtagttctgtccgtaaccctctttgcgcgcgcgcgccagaatggcttccagctttaacggttcccgtgccagttgatagtcatcaccggggcgggaggctaacatttcgattaattccttgcggtcttgttccgggcaaaaggccagccaggtcaggcccgaggcggttttcagaagcggcaaacgtcgcccgaccattgcccggtgaaaggataagcggctgaaacggtgagtggtttcgcgtaccaccattgcatcaacatccagcgtggacacatctgtcggccataccacttcgcgcaacagatcgcccagcagtggggccgccagtgcagaaatccactgttcgtcacgaaatccttcgcttaattgccgcactttgatggtcagtcgaaaactatcatcggaggggctacggcggacatatccctcttcctgcagcgtctccagcagtcgccgcacagtggtgcgatgcaggccgctgagttccgccagcagcccgacgctggcaccgccatcaagtttatttaacatatttaataacattagaccgcgggttaagccgcgcacggttttgtattccgtctgctcattgttctgcatattaattgacatttctatagttaaaacaacgtggtgcacctggtgcacattcgggcatgttttgattgtagccgaaaacacccttcctatactgagcgcacaataaaaaatcatttacatgtttttaacaaaataagttgcgctgtactgtgcgcgcaacgacattttgtccgagtcgtgaggtactgaaatggcaatacaacaccctgacatccagcctgctgttaaccatagcgttcaggtggcgatcgctggtgccggcccggttgggctgatgatggcgaactatctcggccagatgggcattgacgtgctggtggtggagaaactcgataagttgatcgactacccgcgtgcgattggtattgatgacgaggcgctgcgcaccatgcagtcggtcggcctggtcgatgatgttctgccgcacactacgccgtggcacgcgatgcgttttctcaccccgaaaggccgctgttttgctgatattcagccaatgaccgatgaatttggctggccgcgccgtaacgcctttattcagccgcaggtcgatgcggtgatgctggaaggggtgtcgcgttttccgaatgtgcgctgcttgttttcccgcgagctggaggccttcagtcagcaagatgacgaagtgaccttgcacctgaaaacggcagaagggcagcgggaaatagtcaaagcccagtggctggtagcctgtgacggtggagcaagttttgtccgtcgcactctgaatgtgccgtttgaaggtaaaactgcgccaaatcagtggattgtggtagatatcgccaacgatccgttaagtacgccgcatatctatttgtgttgcgatccggtgcgcccgtatgtttctgccgcgctgcctcatgcggtacgtcgctttgaatttatggtgatgccgggagaaaccgaagagcagctgcgtgagccgcaaaatatgcgcaagctgttaagcaaagtgctgcctaatccggacaatgttgaattgattcgccagcgtgtctacacccacaacgcgcgactggcgcaacgtttccgtattgatcgcgtactgctggcgggcgatgccgcgcacatcatgccggtatggcaggggcagggctataacagtggtatgcgcgacgcctttaacctcgcatggaaactggcgttggttatccaggggaaagcccgcgatgcgctgctcgatacctatcaacaagaacgtcgcgatcacgccaaagcgatgattgacctgtccgtgacggcgggcaacgtgctggctccgccgaaacgctggcagggtacgttacgtgacggcgtttcctggctgttgaattatctgccgccagtaaaacgctacttcctcgaaatgcgcttcaagccgatgccgcaatattacggcggtgcgctgatgcgtgagggcgaagcgaagcactctccggtcggcaagatgtttattcagccgaaagtcacgctggaaaacggcgacgtgacgctgctcgataacgcgatcggcgcgaacttcgcggtaattggctggggatgcaatccactgtgggggatgagcgacgagcaaatccagcagtggcgcgcgttgggcacacgcttcattcaggtggtgccggaagtgcaaattcataccgcacaggataaccacgacggcgtactacgcgtgggcgatacgcaaggtcgcctgcgtagctggttcgcgcaacacaatgcttcgctggtggtgatgcgcccggatcgctttgttgccgccaccgccattccgcaaaccctgggcaagaccctgaataaactggcgtcggtgatgacgctgacccgccctgatgccgacgtttctgtcgaaaaggtagcctgatatgcacgcttatcttcactgtctttcccactcgccgctggtggggtatgtcgacccggcgcaagaggtgctcgatgaggtcaatggcgtgattgccagcgcccgcgagcgtattgcggcattctcccctgaactggtggtgctgtttgcgccagatcactacaacggctttttctatgacgtgatgccaccgttctgtttaggcgttggagcgacggcaattggtgatttcggcagtgcggcaggagagctgcccgtgcctgtggagctggcggaggcctgtgcgcatgccgtcatgaagagcgggatcgatcttgccgtttcttactgtatgcaggtggaccacgggttcgcccagccgctggagttcctgctcggtgggctggataaggtgccagttctgcctgtgttcatcaacggtgtcgccacgccgctgcccggtttccagcgtacccgcatgttgggtgaagccattggacgtttcaccagcactctcaataaacgcgtgctgttcctgggttccggtgggctttcccatcagccgccggtgcccgaactggcgaaagccgatgcccatatgcgcgaccgtctgttggggagcgggaaagatttacccgccagtgagcgcgaattgcgtcagcaacgggtgattagcgccgctgagaagtttgttgaggatcagagaacgctgcatccgctcaacccgatttgggataaccagttcatgactttgctggagcagggacgcatacaggaactggatgccgtcagtaacgaagagctttccgccattgccggaaagtcgacacatgaaatcaaaacctgggtcgccgcttttgccgctatttctgcgtttggcaactggcgtagcgaagggcgttattaccgcccaatcccggagtggattgccggatttggctcgttaagcgccagaacagagaactgaatatgcaggagaagatgatgagttatcagccacaaaccgaagccgccaccagccgttttctgaatgtagaagaagcgggtaaaacgctgcgcatccattttaatgactgcggacaaggcgacgaaaccgttgtcctgctgcatggttccggcccgggtgctactggctgggcgaacttcagccgcaatatcgatccgctggtagaggcgggctatcgggtgatcctgctggattgtccgggttggggcaagagcgattcggtcgttaatagtggttcgcgatcggatcttaatgcacgaatcctgaaaagcgtggtggatcaactggatatcgccaaaatccacctgctgggcaactcgatggggggccatagttctgtggcgttcacccttaaatggccggagcgcgtcggcaaactggtgctgatgggcggcggtacgggcggcatgagtttgtttacgccgatgccaaccgaaggtattaagcgactgaatcagctttatcgtcagccgactatcgaaaacctgaagctgatgatggatatcttcgtttttgataccagcgatttgaccgacgccctgtttgaagcgcgcctgaataatatgctgtcgcgccgcgatcacctggaaaacttcgttaagagcctggaagctaatccgaaacagttcccggattttggcccacgtctggcggaaatcaaagcgcaaaccctgattgtctgggggcgcaacgaccgctttgtgccgatggatgcgggtctgcgtctgctgtccggcattgccggttctgaactgcatatcttccgcgactgtggtcactgggcgcagtgggaacatgccgacgctttcaatcaactggtgctgaatttcctcgcacgcccttaaggaatggtcatgacgaagcatactcttgagcaactggcggcggatttacgccgcgccgcagagcagggcgaagcgattgcaccgctgcgcgatctgattggtatcgataacgctgaagcggcttacgccattcagcacataaatgtgcaacatgacgttgcgcaggggcgtcgcgtggtagggcgtaaagtgggcctgacacatccgaaagtgcaacaacaactgggcgttgatcaaccggattttgggacgttatttgccgacatgtgttatggcgataacgaaatcattcctttttcccgtgttctgcaaccccgcattgaagcggagatcgcactggtgttgaaccgcgatttgcccgcaaccgatatcaccttcgacgaattgtataacgccattgaatgggtacttccggcgctggaagtggtggggagccgcattcgcgactggtcgattcagtttgtcgataccgtggcagataacgcctcctgtggggtgtatgtcatcggcggtccggcgcaacgtccggcggggttagacctgaaaaactgcgccatgaagatgacgcgtaataacgaagaggtttctagcgggcgcggcagcgaatgcctgggacatccgcttaatgcggccgtctggctggcacgcaaaatggccagtctgggtgaaccgctgcgcaccggagatatcattcttaccggggcattaggtccgatggtggcggtgaatgcgggcgatcgttttgaagcccatattgaaggcataggttcagttgctgcgacattttcaagcgcagccccaaaaggaagtctgtcatgagtaagcgtaaagtcgccattatcggttctggcaacattggtaccgatctgatgattaaaattttgcgtcacggtcagcatctggagatggcggtgatggttggcattgatcctcagtccgacggtctggcgcgcgccagacgtatgggcgtcgccaccacccatgaaggggtgatcggactgatgaacatgcctgaatttgctgatatcgacattgtatttgatgcgaccagcgccggtgctcatgtgaaaaacgatgccgctttacgcgaagcgaaaccggatattcgcttaattgacctgacgcctgctgccatcggcccttactgcgtgccggtggttaacctcgaggcgaacgtcgatcaactgaacgtcaacatggtcacctgcggcggccaggccaccattccaatggtggcggcagtttcacgcgtggcgcgtgttcattacgccgaaattatcgcttctatcgccagtaaatctgccggacctggcacgcgtgccaatatcgatgaatttacggaaaccacttcccgagccattgaagtggtgggcggcgcggcaaaagggaaggcgattattgtgcttaacccagcagagccaccgttgatgatgcgtgacacggtgtatgtattgagcgacgaagcttcacaagatgatatcgaagcctcaatcaatgaaatggctgaggcggtgcaggcttacgtaccgggttatcgcctgaaacagcgcgtgcagtttgaagttatcccgcaggataaaccggtcaatttaccgggcgtggggcaattctccggactgaaaacagcggtctggctggaagtcgaaggcgcagcgcattatctgcctgcctatgcgggcaacctcgacattatgacttccagtgcgctggcgacagcggaaaaaatggcccagtcactggcgcgcaaggcaggagaagcggcatgaacggtaaaaaactttatatctcggacgtcacattgcgtgacggtatgcacgccattcgtcatcagtattcgctggaaaacgttcgccagattgccaaagcactggacgatgcccgcgtggattcgattgaagtggcccacggcgacggtttgcaaggttccagctttaactatggtttcggcgcacatagcgaccttgaatggattgaagcggcggcggatgtggtgaagcacgccaaaatcgcgacgttgttgctgccaggaatcggcactattcacgatctgaaaaatgcctggcaggctggcgcgcgggtggttcgtgtggcaacgcactgtaccgaagctgatgtttccgcccagcatattcagtatgcccgcgagctcggaatggacaccgttggttttctgatgatgagccatatgaccacgccggagaatctcgccaagcaggcaaagctgatggaaggctacggtgcgacctgtatttatgtggtggattctggcggtgcgatgaacatgagcgatatccgtgaccgtttccgcgccctgaaagcagagctgaaaccagaaacgcaaactggcatgcacgctcaccataacctgagtcttggcgtggcgaactctatcgcggcggtggaagagggctgcgaccgaatcgacgccagcctcgcgggaatgggcgcgggcgcaggtaacgcaccgctggaagtgtttattgccgccgcggataaactgggctggcagcatgggaccgatctctatgcgttaatggatgccgccgacgacctggtgcgtccgttgcaggatcgaccggtacgagtcgatcgcgaaacgctggcgctgggatacgctggtgtttactcgagcttcctgcgtcactgtgaaacggcggcggcgcgttatggcttaagtgcggtggatattctcgttgagctgggcaaacgccggatggttggcggccaggaggatatgatcgttgacgtggcgctggatctgcgcaacaacaaataatgatgactgccgagaacgtgcattttgtatgcccatcccagcacgactgccggatgcggcgtgaacgccttatccggcctacggatggcgtgagaatttgtaggtctgataagacgcgttagcgtcgcatcaggcatctgcgcacgactgccggatgcggcgtgaacgccttatccggcctacggatggcgcgggaatttgtaggcctgataagacgcgttagcgtcgcatcaggcatctgcgcacgactgccggatgcggcgtgaacgccttatccggcctacgggtggcgcgagaatttgtaggcctgataagacgcgttagcgtcgcatcaggcatctgcgcacgactgccggatgcggcgtaaacgccttatccggcctacggatggcgcgggaatttgtaggcctgataagacgcgttagcgtcgcatcaggcatctgcacacgactgccggatgcgataaacgtcttgtccggcctacatttcgcccgtaggcagtcattaaatagttctgattacgcggctggcaatgtatcagtcgcgattcacctgcactcgcaacgaggttcatcttatgtcgactcgtaccccttcatcatcttcatcccgcctgatgctgaccatcgggctttgttttttggtcgctctgatggaagggctggatcttcaggcggctggcattgcggcgggtggcatcgcccaggctttcgcactcgataaaatgcaaatgggctggatatttagcgccggaatactcggtttgctacccggcgcgttggttggcggaatgctggcggaccgttatggtcgcaagcgcattttgattggctcagttgcgctgtttggtttgttctcactggcaacggcgattgcctgggatttcccctcactggtctttgcgcggctgatgaccggtgtcgggctgggggcggcgttgccgaatcttatcgccctgacgtctgaagccgcgggtccacgttttcgtgggacggcagtgagcctgatgtattgcggtgttcccattggcgcggcgctggcggcgacactgggtttcgcgggggcaaacttagcatggcaaacggtgttttgggtaggtggtgtggtgccgttgattctggtgccgctattaatgcgctggctgccggagtcggcggttttcgctggcgaaaaacagtctgcgccaccactgcgtgccttatttgcgccagaaacggcaaccgcgacgctgctgctgtggttgtgttatttcttcactctgctggtggtctacatgttgatcaactggctaccgctacttttggtggagcaaggattccagccatcgcaggcggcaggggtgatgtttgccctgcaaatgggggcggcaagcgggacgttaatgttgggcgcattgatggataagctgcgtccagtaaccatgtcgctactgatttatagcggcatgttagcttcgctgctggcgcttggaacggtgtcgtcatttaacggtatgttgctggcgggatttgtcgcggggttgtttgcgacaggtgggcaaagcgttttgtatgccctggcaccgttgttttacagttcgcagatccgcgcaacaggtgtgggaacagccgtggcggtagggcgtctgggggctatgagcggtccgttactggccgggaaaatgctggcattaggcactggcacggtcggcgtaatggccgcttctgcaccgggtattcttgttgctgggttggcggtgtttattttgatgagccggagatcacgaatacagccgtgcgccgatgcctgacgtgccttattaggcaggggcgaaagggacttcaccccaatacacctacggcgtttacaggtatactcgctaaaaattattcagcgggtttggaaacaaagatggcaaaacttaccttacaagagcagttgctcaaagcaggattagtcaccagcaaaaaagcggcgaaggtggagagaacggcgaaaaaatcgcgcgttcaggcgcgtgaagctcgggcggcggtagaagaaaataaaaaggcacagcttgagcgtgataaacagcttagcgaacagcaaaaacaagcggcgttggcgaaagaatataaagctcaggtgaagcagcttattgaaatgaaccgaatcaccattgccaatggcgatattggttttaacttcactgacggcaatctgattaagaagatttttgtcgataagctcacacaggcgcagttgattaatggtcgtctggcgattgcccgcttgttggtcgataacaatagcgaaggtgaatacgccattattcccgccagcgttgccgataaaattgctcagcgcgatgccagcagtatagtgttgcacagcgcgctcagcgccgaagagcaggatgaagacgacccgtatgccgacttcaaagtgcctgatgatttgatgtggtaaacatagataagtcgtgcgcagatgcctgatgcgacgctatgcgcgtcttatcaggcctacggtttatgggcgaagtgtagaccggataaggcgttcacgccgcatccggcagtcgtgcgccatgcctgatgcgacgctttgcgcgtcttatcaggcctacggcttacgggcgaagtgtaggccggataaggcgttcacgccgcatccggcagtcgtgctattatcaacgcatattcagtttattggcgtggtaggcaatatgctcgccaataaaactggagacaaaataatagctgtgatcataaccctcgtgataacggattaacgtcttgatattcatctcctggcagatcttttcaagatttggagtccgcagctgttctgcgtaaaaatcatcactcaacccctgatcaaccatgatttccgcaacgcgttgaccttgtgaaataagactcaccgggtcgtaatccaaccaggcatctttattttcagcaagatatgcagcaaaggcttgctgtccccacggcacttgcgatggggagacaatgggcgaaaacgccgagacgctgacatattcatctgggttacgtaacgccagcaccagcgcgcccagcccgcccatagaatgaccagagatagactttttggccgttgccggaaaatgatgcatcactaaatccggcagctcgttgcggatatagtcatacattttgtaatgttcattccacggcgcttgcgtcgcgttcaggtaaaacccggcaccttgcccgagatcgtaacggtcagcatctgcgacatgactgcctcgcggactggtgtccggcgcaacaacaataatgttgtgctcagccgcgtaacgctgcatccccgatttagtaatgaaattctgctcgttgcaggtcaggcctgaaagccagtacagcaccggcaatttttcattcgcggcttttggtgggagatagacgccgacattcatttcacatttcagtgattgggaataatgccgatacatattttgccagccgccaaagctgacatgtttttcaatgagttccatcagtcattatctcagggttaatcccccggacggctgcccggggagagtattaagaacccccgcctgaagtggacggggtaaacctgcgggaaatcagtaacgaattacggttcgaatggatttgccttcatgcatcaggtcgaaggcgtcattaatttcatccaggctcatggtatgcgtgacaaacggttccagatcgatatcacctttcatcgcatcttcaaccatgcccggtaactgggaacgacctttcacgccgccaaacgcggaacctttccatacgcgaccagtgaccaactggaatggacgggtggagatttcctgaccggcaaccgcgaccccgatgatcaccgactgaccccagccgcggtgcgcactttccagcgccgcacgcatcacgttgacgttaccgatgcattcaaaggtatggtcgataccccatttgttgatatccaacaggacatcttttatcggtttgtcgtagtcattcgggttaatgcagtcggtagcaccgaagcgacgcgccagatcgaatttcttcgggttggtatcgatagcgataatccgacccgctttcgcctgacgcgcgccctgaaccactgccagaccaatcgcgccaagaccaaacacggcaacagaatcacctggctggactttagctgtgttgtgtaccgcgccaataccggtggtcacgccacagcccagcaggcagacgtgttcatggtttgcttctggattaatttttgccagagacacttccgcgactacggtgtattcactgaatgtagagcaccccatgtagtgataaagcggctgcccgttgtaagaaaaacgggtggtgccgtctggcatcaggcctttaccctgggtttcgcgaaccgcaacacagaggttagttttgccagaacgacagaactcacactcgccgcactccgcggtgtaaagcgggatcacatggtcgccaggtttgacgctggttacgccttcaccgacttcaaccacaacgccggccccttcgtgaccgagaaccaccgggaatacaccttccgggtcatcgccggagagggtaaatgcgtcggtatggcaaacgccggtatgggtgactttaattagcacttcaccttttttcggtggtgcaacgtcaatttcaacgatttccagcggtttaccgggagcaaatgcaacggcagcacgtgatttcatctctcgctcttcctcaatatggtaatagattcagctatttaagataggcacgaaccagttcaatagtgtcgtcaacggattggctgacttcgcggctgtagcagtcatttcggtcaaacgtttcccggatatggctttcaagcacttctgccatcagcccattagccgcgccccgaacggcagcgatctgttggagtatggcacggcattcggcatcaccctccagcgaccgttccagagcatcaatctgcccccgaatacgacgaactcgagtaaggacctttttcttctcttccggagtactgggcatttcgcacctcatcatctgcatgcaatatactataggggggtattctatatgtcaatgcatacccccctatagtatataacactggagaataaaatttatccggtgaatgtggtcggaaaacaaagaggaaaggggggggggctaatcggcagggaaggccgccccggatagcgggcggcagaaggaatcagaatttccaggtcagacgggctgcaagttgcagaccgttaaaatcatcggttggggtgtcgtaccacactttacctgccgtcagcccgagattaagttgctcagtcagcggttgaatacgttgcagactgacgctcttcatgctgccgtagcgtgtttctggcgtccagtcataggtgtaagcacctgttccgcggcttagccatagttgcgtataaccagtgccgcgcgggtcattcagacgcacggaaatcatattgctataactaccacctgcatcgctggagtcataatgggtatagcggtagctggtgatcaccgggccagtatagagtgatacgccgccttgccaggcatcgacttcgacatcatcgtaatatttagtgtagcgataaccggtcgtgaaaagcgtttttggtaacagggccaggttaatatcctgacgaaaatcctggcgggcaaagaccggcgtattatccgcaaaggcaatacccgttcgggttgtcagccagttattccatttataccagaccgcaccctgaccgcgagtggcattgaaatgttcagtttcataatcacgacgcccctgggaaagattaaaaagcagcgttgcgttttcaactttcgccaccagttcagcatacgctaaattacggttgccatgatcgccagaataatcggtaaaatcgtagcccgcggtaatggaagttaacccggcataagcgggcaatgcgctaaaaatggccgccgctaataacgtccgttttatcattttaatctcctgtacggataagttcttgtcggagtgaataagttccggtaggtaaattacgttctacaatcacgcgcgggccaagttgcgtgttcggggaaataattcgcccaggcaaaataataacttgtacgccaaggcgtgaacgctgcccgatataacaacctaatttatcgcatccggtagcgataattccctctggagttcgaacagacacgggctgttcatccagacgatgattactggtacgtacttgtgcgcctaaatatgcctggtttgcaactaccgagtcggcaataaaacattgcggaccaatcgttgcttccgcttcaataaccgcatttttaatctcggtggcaaaaccaatttttacgccattgctgattattgtgccaggacgaataaacgcataattactagactggccccctgaatctccagacaaccaatatcacttaaataagtgatagtcttaatactagtttttagactagtcattggagaacagatgattgatgtcttagggccggagaaacgcagacggcgtaccacacaggaaaagatcgcaattgttcagcagagctttgaaccggggatgacggtctccctcgttgcccggcaacatggtgtagcagccagccagttatttctctggcgtaagcaataccaggaaggaagtcttactgctgtcgccgccggagaacaggttgttcctgcctctgaacttgctgccgccatgaagcagattaaagaactccagcgcctgctcggcaagaaaacgatggaaaatgaactcctcaaagaagccgttgaatatggacgggcaaaaaagtggatagcgcacgcgcccttattgcccggggatggggagtaagcttagtcagccgttgtctccgggtgtcgcgtgcgcagttgcacgtcattctcagacgaaccgatgactggatggatggccgccgcagtcgtcacactgatgatacggatgtgcttctccgtatacaccatgttatcggagagctgccaacgtatggttatcgtcgggtatgggcgctgcttcgcagacaggcagaacttgatggtatgcctgcgatcaatgccaaacgtgtttaccggatcatgcgccagaatgcgctgttgcttgagcgaaaacctgctgtaccgccatcgaaacgggcacatacaggcagagtggccgtgaaagaaagcaatcagcgatggtgctctgacgggttcgagttctgctgtgataacggagagagactgcgtgtcacgttcgcgctggactgctgtgatcgtgaggcactgcactgggcggtcactaccggcggcttcaacagtgaaacagtacaggacgtcatgctgggagcggtggaacgccgcttcggcaacgatcttccgtcgtctccagtggagtggctgacggataatggttcatgctaccgggctaatgaaacacgccagttcgcccggatgttgggacttgaaccgaagaacacggcggtgcggagtccggagagtaacggaatagcagagagcttcgtgaaaacgataaagcgtgactacatcagtatcatgcccaaaccagacgggttaacggcagcaaagaaccttgcagaggcgttcgagcattataacgaatggcatccgcatagtgcgctgggttatcgctcgccacgggaatatctgcggcagcgggcttgtaatgggttaagtgataacagatgtctggaaatataggggcaaatccaattacctatcaggcagtttgcgccaatcactaccggaccctgaataacggcaccatgacaaatacgggtattcgcgccgataacaacttcacctgcagtttcatcaataattacctggtctgcaatctgaatatttttctctttaacattaagcttcagatagtttttcagttcctgtgacagaaggttgggaataagcggttgacgcttccaccagtgcggaatagcgggtgggtttgtcgcgctgaggttcgcgtccagtaaaaaaggcaataagtccataaataatccagatggcataagctaataatacatacacaacggaaagcggcgctaaaggcaccaacaaccagcaacgatgaaaccaggcgctaaaagcaccaataacacaaactacgccgacccagataagcggaaacattgccaacaccactccatgcggcccggtggtgatgaattcattaaaccaggtagtgagataaatcccaacgccataaagcacaaccaacagcataggaaatatactgaagataccgaagcggctaaataaaagtcttttatgcaggcgcatacagaccgcgtatcccacaatccaacgccgccagcgacgccactcctcacgcgggctgttgcattcctgtgggtatacgatgcagcgattcgcctgccgaatacggtagccgtttgccaccaatgtccaggtgagatcaaggtcttcgactttagtacgatccgagaaaccgaacttacgcaatacatcagtacggaacatcccgcaggcaccgctgataataaacggtgcgccacccaggagctgctgtagcgtgcgcttcataacaatcatcggcaactttacggtcgcgcggatgtgcggtaacagacccgcgcctttcaacgcagtagagggaatgccgcctacggcatcggcaccgcgctcaatttctgccagcatatagcccattccgtcttgatcgggcggaacataggtgtcggcatcacttaaaaaaacctggtcgcaggtggcgtaattgaggccattcatcagcgcaccacctttaccggtatttttttgcgtgacggcaacaaagcggtcgccccatttgcgtttgacttccgccatgaccgcttcggtattgtccgtggagccgtcgttaacgcaaattacccggcaaaaataagggttacgcagtagattatccagtgactgcgccagacacgggccttcgttatacgcaggtataatggcgtcaatacagcctttcttttgactgggtttacgtcttagcgtacttaaaaaccatagcaacattgctatggacatacagataaatatccaggttttcatgcaatttgctcaaagaatcattttatgaattacaaagccttcacccagatcgctattgacctgttgtccgcgaaattgtgcaactgcacgcaggcgatcatgacgcatataatcgcgtcgttcctagcttttatgtttttttaatgcagcaagtttgactgtgaaatattcttctttaacggattcaaaaacctgaggcataaatgaaagccaggtacttggggtttcgtagccgagaatttgcggaatagttcggcaggcaaccattgaagcttgataaacagcaagatgatcctgatggcggtcggcatcatgcatggtatatacccgcatgatttcaacatcagaaggaatttgatttttaatgatgtcttccagggcggaaatcatatcattgagctgtaaatgagcgcgggtgtcagcaaaattaagatgaatagtttggtggcaccctaatatctttagggcgttgcgcgattcttcatggcgatcgattattccatctgtgccagagttgccggtagtcatcaccacggctgcgatataaattcctttttgcgcaagacgagcaagcgatgcgccacagcctaattctatatcgtcaggatgtgcgccaatagcaaggataccctttcttttatttgccgaagaaaggagggctgaatctaaaaccttatccacttaatgacactccattttatttattatactacaagcacaacgatgcactcagagacgtaatctctggcgcagccagatgttaatttataaatgttaaatgttgctaataactgaaaagcaagggctttcagacccgtgggttcgactgggtaatgtttctatgcaattcatatgttaagtgtttgtatgtttggtatgtatagttattttgttttatacattgtatttagatgtgatttagtttgtcaattaattgcatttaaaaaatatgttctgtgaacaagcattgtttatatacattatgtgaatgtaatatgcgagtgattgagaatgatacagtgatatatacaatgcgaatataatagttttattatatgtattgatattgatagaaataatgaagtaataaatctcgtaatgtggttgtttatgcatcactaaaatgaagtgtagtaattttcccaattgttagaacggagtaattgcatatttaatctttccttagccgtttttttgctaagaataaaatcatctgtgcgataacgactaattcttttaatgaatgtttttattcctgaatactgctcccataacaagacaggggagcagacaatcatggcaatttcatcgcgtaacacacttcttgccgcactggcattcatcgcttttcaggcacaggcggtgaacgtcaccgtggcgtatcaaacctcagccgaaccggcgaaagtggctcaggccgacaacacctttgctaaagaaagcggagcaaccgtggactggcgtaagtttgacagcggagccagcatcgtgcgggcgctggcttcaggcgacgtgcaaatcggcaacctcggttccagcccgttagcggttgcagccagccaacaggtgccgattgaagtcttcttgctggcgtcaaaactgggtaactccgaagcgctggtggtaaagaaaactatcagcaaaccggaagatctgattggcaaacgcatcgccgtaccgtttatctccaccacccactacagcctgctggcggcactgaaacactggggcattaaacccgggcaagtggagattgtgaacctgcagccgcccgcgattatcgctgcctggcagcggggagatattgatggtgcttatgtctgggcaccggcggttaacgccctggaaaaagacggcaaggtgttgaccgattctgaacaggtcgggcagtggggcgcgccaacgctggacgtctgggtggtgcgcaaagattttgccgagaaacatcctgaggtcgtgaaagcgttcgctaaaagcgccatcgatgctcagcaaccgtacattgctaacccagacgtgtggctgaaacagccggaaaacatcagcaaactggcgcgtttaagcggcgtgcctgaaggtgacgttccggggctggtgaaggggaatacctatctgacgccgcagcaacaaacggcagaactgaccggaccggtgaacaaagcgatcatcgacaccgcgcagtttttgaaagagcagggcaaggtcccggctgtagcgaatgattacagccagtacgttacctcgcgcttcgtgcaataaaaggaggcgcagatgctgcaaatctctcatctttacgccgattatggcggcaaaccggcactggaagatatcaacctgacgctggaaagcggcgagctactggtggtgctggggccgtccggctgcggtaaaaccaccctgctgaatctgattgccggttttgtgccttatcagcatggcagcattcaactggcgggtaagcgtattgagggaccgggagcagagcgtggcgtagtttttcagaatgaagggctactaccgtggcgcaatgtacaggacaacgtggcgttcggcctgcaattggcaggtatagagaaaatgcagcgactggaaatcgcgcaccagatgctgaaaaaagtggggctggaaggcgcagaaaaacgctacatctggcagctttccggtggtcaacgtcagcgggtggggattgctcgtgcgctggcggcgaatccccagctgttattactcgacgaaccgtttggtgcgctggacgccttcacccgcgaccagatgcaaaccctgctgctgaaactctggcaggagacgggcaagcaggtgctgttgattacccacgatatagaagaagcggtgtttatggcgactgaactggttctgctttcatccggccctggccgtgtgctggagcggctgccgctcaactttgctcgccgctttgttgcgggagagtcgagccgcagcatcaagtccgatccacaattcatcgccatgcgcgaatatgttttaagccgcgtatttgagcaacgggaggcgttctcatgagtgtgctcattaatgaaaaactgcattcgcggcggctgaaatggcgctggccgctctcgcgtcaggtgaccttaagcattggcacgttagcggttttactcaccgtatggtggacggtggcgacgctgcaactgattagcccgctatttttgccgccgccgcaacaggtactggaaaaactactcaccattgccggaccgcaaggctttatggacgccacgctgtggcagcatctggcagccagtctgacgcgcattatgctggcgctatttgcagcggtgttgttcggtattccggtcgggatcgcgatgggacttagccctacggtacgcggcattctggatccgataatcgagctttatcgtccggtgccgccgctggcttatttgccgctgatggtgatctggtttggtattggtgaaacctcgaagatcttactgatctatttagcgatttttgcaccggtggcgatgtcggcgctggcgggggtgaaaagcgtgcagcaggttcgcattcgtgccgcccagtcgctgggtgccagccgtgcgcaggtgctgtggtttgtcattttgcccggtgcgctgccggaaatcctcaccggattacgtattggtctgggggtgggctggtctacgctggtggcggcggagctgattgccgcgacgcgcggtttaggatttatggttcagtcagcgggtgaatttctcgcaactgacgtggtgctggcggggatcgcggtgattgcgattatcgcctttcttttagaactgggtctgcgcgcgttacagcgccgcctgacgccctggcatggagaagtacaatgagtgaacgtctgagcattaccccgctggggccgtatatcggcgcacaaatttcgggtgccgacctgacgcgcccgttaagcgataatcagtttgaacagctttaccatgcggtgctgcgccatcaggtggtgtttctacgcgatcaagctattacgccgcagcagcaacgcgcgctggcccagcgttttggcgaattgcatattcaccctgtttacccgcatgccgaaggggttgacgagatcatcgtgctggatacccataacgataatccgccagataacgacaactggcataccgatgtgacatttattgaaacgccacccgcaggggcgattctggcagctaaagagttaccttcgaccggcggtgatacgctctggaccagcggtattgcggcctatgaggcgctctctgttcccttccgccagctgctgagtgggctgcgtgcggagcatgatttccgtaaatcgttcccggaatacaaataccgcaaaaccgaggaggaacatcaacgctggcgcgaggcggtcgcgaaaaacccgccgttgctacatccggtggtgcgaacgcatccggtgagcggtaaacaggcgctgtttgtgaatgaaggctttactacgcgaattgttgatgtgagcgagaaagagagcgaagccttgttaagttttttgtttgcccatatcaccaaaccggagtttcaggtgcgctggcgctggcaaccaaatgatattgcgatttgggataaccgcgtgacccagcactatgccaatgccgattacctgccacagcgacggataatgcatcgggcgacgatccttggggataaaccgttttatcgggcggggtaatacgagagtggacggtcccctcgcccccttggggagagggttagggtgagggggcgttcaccgtactttcaacaggttaactccccctttctgagaggaaacaaaattaacgcagaatcttcttctcagccaaatccagcgcaaagtagctgaaaatcagatccgcacccgcacgcttaatcgaacctaagctttcgagcacgactttctcttcatctatagcacccgccagcgcggcgaacttaatcatcgcatactcaccgctcacctgatacgcgccaatcggcaattcagtacgttcacgcagctcacgcacgatgtcgaggtacgctccagcaggtttaaccatcaggcagtctgcgccctgggcttcatccagcagtgattcacgaatcgcctcacgacggttcattgggttcatctgatagcttttgcggtcgccttttaatgcgcttccggcagcttcacggaacgggccataaaaggaggaggcgaacttggtcgaatacgacataatcgccgtatctttaaatcccgcagcgtccagcgcctgacgaatcgcctgtacctggccgtccatcgcggcggaaggggcgatgaagtctgcacctgcagcagctgcaaccacggcttgcttgcctaaattttccagagtcgcgtcgttgtcgacgccatgctcgcacagcacaccgcagtgaccgtgagaagtgtattcacagaagcaggtgtctgacataacgatcatttctggcacggtctgcttgcagatgcgcgacatacgcgccaccagtccatcttcccgccaggcatcgctgccggtttcatcggtatggtgagagatgccaaaagtcatcacggaacgaataccggcgttggcgatgcgttcaatttcgcgtgccagatgtttctctggaatgcgcatcacgcctggcatggcttcaacggctttgtagtcgtcaatttcttcttcaacaaagatcggcaacaccaggtcgttaaggctaagtgttgtctcttcaaacatagcgcgcagcgcaggagatttgcgcaggcgacgagggcgttggattaagtctgtcatggtctgcctgatgtttgtggaatcgaggggcatagtatacctgaagcagggtagggatgttttacgaaagttgtcgcgatgttgacaagaagagaatggaagagaggccaggacatctttttaatagaaacagcaataattttatattcactgaaaatatttttaatctttatttatagctgttggttattattttttggagtttggttgcgctgctataaattgaataattaaaactttgttgcatattcataggatatttatctggtttgtgtttgtgatatttattatgcgtatgcttcaaaaacaaaattatctgcaacatgttgaaatactgtgcttttatgaatttgatgcgtgtttttctccataaattatatatgtccacattcggacttaggggaaagaataattgaaccattcgtctgtaacgcagcataatcgttagcgcgaaacataatatgttttctatgcattgataattgatggatcaacttattacgtccctgaggagggatgacaaatgcactcctggaaaaagaaacttgtagtatcacaattagcattggcttgcactctggctatcacctctcaggctaatgcagcaaactatgatacctggacttatatcgataatcccgttacagcacttgattgggatcatatggataaggcaggcactgtagatggcaactatgtaaactatagtggttttgtctattacaacaacaccaatggtgatttcgatcagtcctttaacggcgataccgttaacggcacgatctcaacctattatttgaaccatgattatgcagacagtactgctaatcagcttgatatcagtaattcagtgattcacggttcgattacttctatgctgcctggcggttattatgatcgttttgatgcagatggtaataatctgggtggatatgatttttacactgatgcggttgttgatacacactggcgtgatggtgatgttttcactttgaacattgctaacactactattgatgatgattatgaagctctttacttcactgattcttataaagatggtgatgtaaccaagcacacaaatgagacatttgatacaagtgaaggcgttgctgttaatcttgatgtagaaagtaacatcaatatttccaataactcccgcgttgcaggtattgcattatctcaaggtaatacttacaacgaaacctacactaccgaatctcatacttgggataacaatatctctgtaaaagattccacagtgacttcgggttcaaattatatcctggatagcaatacttatggcaaaactggtcactttggcaattctgatgaaccgagtgattatgctggcccgggtgatgttgcaatgtcctttactgcttcaggttccgactatgcgatgaagaacaatgtattcctcagcaattcaacgctgatgggtgatgttgcctttaccagcacctggaatagtaattttgatccgaatggtcatgattccaacggtgacggggtgaaagataccaacgggggttggactgatgatagcctcaacgttgatgaactaaatctcactctcgataacggaagcaagtgggttggtcaggcaatttataacgttgctgaaacgtcagcaatgtatgatgttgctacaaacagccttactcctgatgcaacatatgaaaacaatgactggaaacgtgttgttgatgacaaggtcttccagagcggtgtatttaacgtagcgttgaataacggttctgaatgggatactacaggtcgttccatcgttgataccttgacagttaataatggttctcaggttaatgtttcggaatctaaattaacttcagatactatcgatttaactaacggttcttcgctgaacattggtgaagatggctacgttgataccgatcatctgactattaactcctacagtactgttgcgttgaccgaatctactgggtggggggctgattgatcctacccacgtaatatggacacaggcctaagcgaggttcttgttttcaaattgttccggactgaggccgccacaccaactgtgccgccgccaccgattgtaatcacattcgatataattaaacaccgttgcccgcattatttcccggctgataaagtgttctccatggatacattccactttcagcgaatgaaagaagctttccacgcaggcattatcgtagcagcaaccttttgcgctcatacttccacgcagattatgccgcttcagttgcgcctgataatctgctgaacagtactggcctccacggtccgtgtgaacgataacgttccggggcctcttacgccgccacagcgccatctgcagggcatcgcaggccagttgcgccgtcatgcgtggcgacattgaccagccaataacggcacgtgaccacaggtcaatgaccactgccagatacagccagccttcatctgtacgtaagtacgtgatgtctcctgcccacttctggttcgggccactggcgtaaaaatcctgctccaacagattttctgacacaggcaggccgtgtgcgcggtagctgaccgggctgaacttccgggaggcctttgccctcagtccctgacggcgcaggcttgccgccacggtttttacgttaaaggggtaaccctgagcacgcagttcatccgtcaggcgtggggcaccgtaacgctgttttgaccgggtaaaagccgcgaggacaacgctgtcgcagtgttggcggaactgctgacgcgtgcttatccttgtccgccgctgacaccacgtataccagccgctgcgggccacccggagcacgcggcacattgctttgatgctgaactcagcctgatgtttttcaataaagacatacttcatttcaggcgcttcgcgaagtatgtcgcggccttttggaggatagccagctcttcatcccgttctgccagctggcgtttgagacgtgcaatctcggtagacatctccagttcacgttcagaagacgtctgctgattttgctgtttactgcgccagttgtagagttgtgattcatacaggctgagttcacgggctgcggcagtaacaccgatgcgttcagcaagcttcagggcttcactgcgaaattcaggcgaatgctgtttacggggttttttactggttgatactgtttttgtcatgtgagtcacctctgactgagagtttactcacttagccgcgtgtccactattgctgggtaagatcagattacaacctgtacgccaatactatcaccgtaactaacggcggtgtattggatgtgaacgttgatcagttcgatactgaagctttccgtactgacaaactggaactgaccagcggcaacatcgctgaccataacggtaacgtagtatctggtgtgttcgatatccatagcagcgattacgttctgaacgctgatctggtgaacgaccgtacctgggatacttccaagtctaactacggttacggtattgttgctatgaactctgatggtcacctgactatcaacggtaacggcgacgtagacaacggtactgaactggataacagctctgtagacaatgttgttgctgcaaccggtaactacaaagttcgtatcgacaacgcaactggcgctggcgctatcgctgattacaaagataaagaaattatctacgtaaacgacgtcaacagcaacgcgaccttctctgctgctaacaaagctgacctgggtgcatacacctatcaggctgaacagcgcggtaacaccgttgttctgcaacagatggagctgaccgactacgctaacatggcgctgagcatcccgtctgcgaacaccaatatctggaacctggaacaagacaccgttggtactcgtctgaccaactctcgtcatggcctggctgataacggcggcgcatgggtaagctacttcggtggtaacttcaacggcgacaacggcaccatcaactatgatcaggatgttaacggcatcatggtcggtgttgataccaaaattgacggtaacaacgctaagtggatcgtcggtgcggctgcaggcttcgctaaaggtgacatgaatgaccgttctggtcaggtggatcaagacagccagactgcctacatctactcttctgctcacttcgcgaacaacgtctttgttgatggtagcttgagctactctcacttcaacaacgacctgtctgcaaccatgagcaacggtacttacgttgacggtagcaccaactccgacgcttggggcttcggtttgaaagccggttacgacttcaaactgggtgatgctggttacgtgactccttacggcagcgtttctggtctgttccagtctggtgatgactaccagctgagcaacgacatgaaagttgacggtcagtcttacgacagcatgcgttatgaactgggtgtagatgcaggttataccttcacctacagcgaagatcaggctctgactccgtacttcaaactggcttacgtctacgacgactctaacaacgataacgatgtgaacggcgattccatcgataacggtactgaagggtctgcggtacgtgttggtctgggtactcagtttagcttcaccaagaacttcagcgcctataccgatgctaactacctcggtggtggtgacgtagatcaagactggtccgcgaacgtgggtgttaaatatacctggtaatattcttcactccgaagaaatactggtaatttaatctaaataatgcccgtcaaggatttgacgggcattactgcaaaggacgcgcaaatgttatctgtagttaaacctcttcaggaatttggtaagctcgataaatgtttgtccagatacggtacgcgcttcgagtttaataatgaaaagcaagttatattttccagtgatgtcaataacgaagatactttcgttattttagagggagttatctctctgcgtagagaagaaaacgtacttatcggtattacccaggctccttatattatggggctggctgatggtttaatgaaaaacgatataccatacaaattaatatcagaaggaaattgtacgggatatcatctaccagccaaacaaaccattacgcttattgaacaaaatcaactctggcgagacgctttttactggttagcctggcaaaatagaattctggaattacgcgacgtgcagctcattgggcataattcctacgaacaaatccgcgcaacattattatcaatgattgactggaatgaagaattgcgatcacgtattggtgtgatgaattatatccatcaacgtacacgcatatcgcgttctgtcgtcgcagaagttctcgctgctttgcgtaaaggcggctatatcgaaatgaataaaggcaaactggtcgctatcaaccgtttgccttcagagtattaatcaggacgcggggataaccaacggtttattcccgcttagctcggtcaccaggtcattgatgccatcgctcatatttttaaagcgcgtcaacggcgaacgagtgaccaccacaaacgcgccaatattcttctgcgggatcatcgccatataggtaatgaaaccgccaccaccgcctgtcttctgaataatccccggacgaccctctttcggggccatatatacccaacctaaaccaagcgcatccgctttgccggggacatccatgccaatcactttcgtaaactgcgcgcgctgataaatcaacgtctgcatgcgatctgcctggttactgcgctgataaaaatcagatgacaaatactgctgcatccagcgcatcatatcgccaggcgtggaatagacgccgccgctgccaattgccgccagcgtgttattgcacggactggcaccgcgctcagcaaccattaaacggcggcactgatccggtgagggggtgtaggtggtgtctttcatccccaatggacgggtaatctgctcttcaaacaactgggtataaggcttgccggacgcattcgccagtgcatctgccagcaggtcgaacgcaaggttagagtacgccgcctgactgcctggcgcggctttcagcttcgccgtagaaaggtatttccagcgttgctcgcgcgttggccagacaaacaccggacgatgtgccgcgccaccgggctgttcacggggcagggcgctggtatgggttgccagattgaccagcgtaatgggcgtcccattgtaggttggcacgcgtgcgcctggcggagcatatttacttagcggatcgtttaacttcacggtcccctggtcgagcaatttcaccagcatctcactggtcattagcttggtgagggaagcaatacgcacgaccgaatccagctgcgggcgaacgttattaccaggtcgcgtttcgccataactgcgaaagacgcgctggttaccgtcgataacaaccagagccatccccgtggcaccgctgccgtaaaaaatatgatcggcataacgatcgacaatatcagaggcaaactccggttcagtgatcggctgcgccgcatggacggaggtcaatgacgccgcacacagcacggcagaaaaaagcagactacgtttcaacggtggtgtccatagattgaatgaaggtaactgagcgtatttatactactcattgatagattgcaaagggcgaattagtgcaataatagtgttaaaaacgtaacggcgcgtaaacacgatctttttcctgctcaccaatgcctgcatttgtgatcctgcgcgtgttaatccgcttatgtaaacaatctttggtttgtgaaatccgtcgaaacaattcttatggtcaggctggcgaactaagcgccttgctatgggtcacaatgggcggtttcatttggctgacgctttgtagcggtcatgcggttaatacacagcagttgttaaaacgataagaagttagcaggagtgcatatgtttaagtcttttttcccaaagccgggaacgttttttctctcggccttcgtttgggcattgattgccgttatcttctggcaagccggtgggggtgactgggtggcgcgtatcaccggcgcttccgggcagatcccgattagcgccgcgcgtttctggtcgttggatttcctgattttttacgcttactacattgtttgcgtaggactttttgcattgttctggtttatctacagcccgcatcgttggcaatactggtcaatactcggtactgcactgatcatcttcgtcacctggtttttggtggaagtcggggtcgccgtcaacgcctggtatgcgccgttctatgatctgattcaaaccgcgctaagttcgccgcataaagtcaccatcgaacaattttaccgcgaagtgggcgtctttctggggattgcgctgatcgctgtggtgatcagtgtgctgaacaacttctttgtcagtcactacgtgttccgctggcgtacagcgatgaacgaatattacatggcgaactggcaacaactgcgtcatatcgaaggggccgcacagcgtgtgcaggaagacaccatgcgttttgcttcaacgctggagaatatgggcgtcagttttatcaacgccatcatgacgttgatcgccttcctgccggtgctggtaacgctctccgcgcatgtgccggagctgccgattatcgggcacattccgtatggtctggtgattgccgcaatcgtctggtcgctgatggggaccggattgctggcagtggtagggatcaaactgccggggctggagtttaaaaaccagcgtgtagaggctgcctaccgtaaagagctggtttatggtgaagacgatgccacgcgcgcgacgccgcctacggtacgcgagctgtttagcgccgtacggaaaaactatttccgcctctattttcactatatgtatttcaacatcgcccgcattctctatttgcaggtcgataacgttttcggtttgttcttgctgtttccgtcaattgttgccggtacgattacgctcggcctgatgacgcagattaccaacgtttttggtcaggttcgcggtgctttccagtacctgattaactcatggaccacactggttgagttgatgtctatctacaaacgtctgcgcagctttgaacatgagctggatggtgacaaaattcaggaagtaacccataccttgagctaaaaaggagaagtaatgtcgcgcgtcaatcctctatcttcgctgtcattgttggcggttctggttttagcggggtgtagtagtcaggctccgcaaccgttgaaaaagggcgaaaaagcgatagatgtagcgagcgtcgtgcggcagaagatgcctgcgagcgtgaaagaccgcgatgcctgggcgaaagatctcgccaccacctttgaaagtcaggggctggcaccgacgctggaaaacgtctgctcggtgctggcggtggcgcagcaggagtcaaattatcaggcagatccggccgttccgggcttaagcaagatcgcctggcaagagattgaccgtcgtgctgaacggatgcacattcctgcttttctggttcataccgcgctaaaaatcaaatcgccaaacggcaaaagttatagcgaacggttagattcggtgcgtacagaaaagcaattgagcgcgatttttgacgatctgatcaacatggtgccaatggggcagacgctgtttggttcgctcaatccggtgcgcaccggtgggccgatgcaggtcagcattgcttttgccgaacagcataccaaagggtatccgtggaaaatggacggtacagtccgtcaggaagtcttcagtcgccgcggcgggttgtggtttggtacttaccatttactgaattatcccgccagttatagcgcaccgatataccgttttgctgattttaacgctggctggtacgccagccgtaatgccgcgtttcagaacgcggtcagtaaggccagcggcgtgaagctggcactggacggtgatttaattcgttacgacagtaaagaacccgggaaaaccgaactggcaacgcgcaaactggctgcaaaactggggatgagcgacagcgaaattcgccgtcagttagagaaaggtgacagcttctcttttgaggagacggcgctgtacaagaaagtttatcaacttgccgaaacgaaaacgggtaaatcactcccccgcgaaatgttgcctggcattcaactggaaagcccgaaaatcacccgcaacctgactacggcctggtttgcgaagcgcgtagacgaacggcgggcgcgttgtatgaaacagtgatcaaacaggaatgtcaggccagataaggcgtttcaggccgcatctgacaatgtaaaacttactggcggcgatgtcgccagtgcagccatagcgccaccactgcaaaaatgaggcagcctactaaaaacgggatcagcccgaaaatggtgccgacacctaaaccaatttccacccgtgggcgacctgtttcctggacctgcattaaacgctcatagacgccgggcgcatgcactaacaggttcagcaattgcgccccagcccaaaagcaaaacagcacaaacaacgcataggcaatgttgccaggcgttgaagaggcattgcgatattttccgctaaacagcgattttgacagggtgaaatcagccataaaaacctccggaagtcatctgcttctcttctggtgtgataccagcggcttatggcaagtctgacaggtcatttagattgtcaatatcagaatcatggtaaattgatgttgggaatattcccgaagcgtgaatcttcgttgtgagtcacaaaatggcaaccttaagttaaatttattaacaattacgaaaatgttgtctacaccacagacggttgttgcagaatatgcaaggatgttgtttttcgttaacggagctgccatgaatctgcctgtaaaaatccgccgtgactggcactactatgcgttcgccattggccttatattcattcttaatggcgtggtggggttactgggatttgaagcaaaaggttggcagacctatgccgtcggtctggtgacgtgggtgattagtttctggctggcggggttgattattcgtcgtcgcgatgaagaaactgaaaacgcccaataagaatattatcgggcgttaaaatattacattgtggttttcaatgcgttatccgcagcgtgacgctccagcgccagttcaatcaaacgtgtgatcagatcggtgtaacccagaccgctggcttgccacagcttcggatacatactgatattagtgaagccaggcagggtgttgatctcgttgatcaccacttcgttctctggggttaaaaacacgtctacacgcgccatgcctgcgcatcccaacgtttgataagcctgaacggcaatcgcccggatcttatcgttgatttctggcgcaatggctgccggaactaccactttcgcgccatcttcgtcaatgtacttggtgtcgtaggcatagaaatcgctggtgagtacgatctctccacaggtgctggcttgcggattgtcgttgcccagaactgcgcattcgatctcacgacctttgatcccttgctcaacgatcactttatgatcgaactcgaacgccagatcgacggcaattgcgtactgttcttcactggttactttgctgacaccaacagaagagccctgattagccggttttacaaacagtggtaaccccagtttagactccacttcggcaaaactaatgttgtgacgattggcgcgcgtcagggtaataaatggcgcaatgttcagcccggcatcgcgtagcagacgtttggtgacatctttgtccatacaggctgctgaagccagaacatcagaacctacaaacggtaaattggcgacccgcagcattccctgcaaggaaccatcttcgcccagcgtaccgtggacaatcgggaaaatgacatccaccgtcggcaacggctgaccgttttgcgcgtcgataagctgatgctcatgtttacctggcacctgcgcaaggctggtcgccgaagggcgcaacgcaatatgggcaggatcgtctgcatttagcagataattgctggcatcgctgacgtgccattgcccttgtttatcaatgcccagcagcacaacgtcgaagcgacttttatcaatggcatcgacaatgttttttgccgattgcagagacacttcatgttccgctgatttaccaccaaaaacgattcctacccgcagtttttccatcttaaaaacctatcccgtctaacacaaagtgcatacattaccacgacaaaacgggggattcgcggccttctgaaagattgttgcaatcttctgctgacaaagcgtgcaacgtactggtgaagaaagtgcgttatctcaaagatgtgcgcaagatcacaaaaatgatgaacgggaagctaatttattcctggcttaaatggccatgcggtgagtttttttctcttaattataagttaacgaagagaatatatttcataacttttatttataataaaggttgataattaaaagcctatattttgtgtgggtaattatttaaataagagaaacgtttcgctggtaatcaaacaaaaaatatttgcgcaaagtatttcctttgtcataaaaataatacttccagacactatgaagttgtgaaacataatgttaacttctccatactttggataaggaaatacagacatgaaaaatctcattgctgagttgttatttaagcttgcccaaaaagaagaagagtcgaaagaactgtgtgcgcaggtagaagctttggagattatcgtcactgcaatgcttcgcaatatggcgcaaaatgaccaacagcggttgattgatcaggtagagggggcgctgtacgaggtaaagcccgatgccagcattcctgacgacgatacggagctgctgcgcgattacgtaaagaagttattgaagcatcctcgtcagtaaaaagttaatcttttcaacagctgtcataaagttgtcacggccgagacttatagtcgctttgtttttattttttaatgtatttgtacatggagaaaataaagtgaaacaaagcactattgcactggcactcttaccgttactgtttacccctgtgacaaaagcccggacaccagaaatgcctgttctggaaaaccgggctgctcagggcgatattactgcacccggcggtgctcgccgtttaacgggtgatcagactgccgctctgcgtgattctcttagcgataaacctgcaaaaaatattattttgctgattggcgatgggatgggggactcggaaattactgccgcacgtaattatgccgaaggtgcgggcggcttttttaaaggtatagatgccttaccgcttaccgggcaatacactcactatgcgctgaataaaaaaaccggcaaaccggactacgtcaccgactcggctgcatcagcaaccgcctggtcaaccggtgtcaaaacctataacggcgcgctgggcgtcgatattcacgaaaaagatcacccaacgattctggaaatggcaaaagccgcaggtctggcgaccggtaacgtttctaccgcagagttgcaggatgccacgcccgctgcgctggtggcacatgtgacctcgcgcaaatgctacggtccgagcgcgaccagtgaaaaatgtccgggtaacgctctggaaaaaggcggaaaaggatcgattaccgaacagctgcttaacgctcgtgccgacgttacgcttggcggcggcgcaaaaacctttgctgaaacggcaaccgctggtgaatggcagggaaaaacgctgcgtgaacaggcacaggcgcgtggttatcagttggtgagcgatgctgcctcactgaattcggtgacggaagcgaatcagcaaaaacccctgcttggcctgtttgctgacggcaatatgccagtgcgctggctaggaccgaaagcaacgtaccatggcaatatcgataagcccgcagtcacctgtacgccaaatccgcaacgtaatgacagtgtaccaaccctggcgcagatgaccgacaaagccattgaattgttgagtaaaaatgagaaaggctttttcctgcaagttgaaggtgcgtcaatcgataaacaggatcatgctgcgaatccttgtgggcaaattggcgagacggtcgatctcgatgaagccgtacaacgggcgctggaattcgctaaaaaggagggtaacacgctggtcatagtcaccgctgatcacgcccacgccagccagattgttgcgccggataccaaagctccgggcctcacccaggcgctaaataccaaagatggcgcagtgatggtgatgagttacgggaactccgaagaggattcacaagaacataccggcagtcagttgcgtattgcggcgtatggcccgcatgccgccaatgttgttggactgaccgaccagaccgatctcttctacaccatgaaagccgctctggggctgaaataaaaccgcgcccggcagtgaattttcgctgccgggtggtttttttgctgttagcaaccagacttaatggcagatcacgggcgcatacgctcatggttaaaacatgaagagggatggtgctatgaaaataacattactggttaccttgcttttcggtctggtttttttaaccaccgtcggcgctgccgagagaactttaaccccacaacaacagcgtatgacctcctgtaatcagcaggcgacggcgcaggcgttgaaaggggatgctcgtaagacctacatgagtgattgcctgaagaacagcaagtctgcgcctggcgaaaaaagtttgacgccacagcagcaaaagatgcgcgaatgcaataatcaagcaacacaacaatctctgaaaggtgatgatcgtaataagtttatgagtgcctgcctcaagaaagccgcctgatacctgatagtgctaacgggtgagctacgaaaatggctcacccgaaatatcatacttctgcctttagctccgtctctataatttgggaaaattgtttctgaatgttcccaaaaataatgaatgatgaaaactttttcaaaaaagcggcggcgcacggggaggaacctcctttaactcctcaaaacgaacatcagcggtccgggctgcgcttcgcccgtcgcgtcagactaccccgtgcggttggcctggctggcatgttcttaccgattgcttcaacgctggtttcacacccgccgccgggctggtggtggctggtgttggtcggctgggcgttcgtctggccgcatttagcctggcagatagcgagcagggccgtcgatccgcttagccgggaaatttacaacttaaaaaccgatgcagtattagcgggaatgtgggtaggcgtaatgggcgtaaacgtgctgccttccaccgcgatgttgatgattatgtgtctgaatttgatgggggcaggcggcccccgtctgtttgtcgcgggtctggtgttgatggtggtttcctgccttgtcaccctcgagctgacgggcattaccgtgtcgttcaatagtgcgccgctggaatggtggctctcccttcccattattgtcatttatcctctgctgtttggctgggtcagctaccagacggcaaccaaactggcggaacataaacgcaggttgcaggtcatgagtacccgcgacggcatgacgggcgtgtataaccgacgtcattgggaaactatgttacgcaatgaatttgataactgtcggcggcataatcgcgatgcaacgttactgattatcgatatcgaccatttcaagagcatcaacgatacctggggccatgatgtgggcgatgaagcgattgtggcgcttacccgacagttacaaattaccctgcgcggtagcgatgtgattggtcggtttggcggcgatgagtttgcagtaatcatgtccggtacgccagctgagagcgccattaccgccatgttacgggtgcatgaagggctaaatacattacgtttgccgaatacgccacaggtaactttacggattagtgtgggggttgcgccgctgaacccacaaatgagtcactatcgtgagtggttgaaatcggcagatttggcgctttacaaagcaaagaaagccggacgtaaccgcaccgaagtggcggcctgacgtccggcgaaagtcatcaggatttgctgagtttttctgatttttccatacacttcgtcatcgcttcgatcactgcagcacggaagcctttctcttccagtacgcgtaccgcttcaatggtggtgcctcccggtgagcagaccatatctttcagtgcccccggatgttctcccgtttccagcaccatttttgcggaacccattaccgcctgagcggcaaatttatacgcctgggcgcgtggcatcccgcccagcacggcggcgtcggccatcgcttcgataaacataaatacgtaggctggcgaagaaccgctcacaccgaccaccgggtggatcatcggctcagcaattacttccgcttcgccaaagcagcggaaaatattcagcacatcagcggtatcttctggggttaccagcgcgtttggcgttacggaggtcatcccggcattaaccagtgcgggagtgttcggcatggcgcggataattttccggtcatggcccagcgcgcgggcaagctggtcgagcgtgacacctgcagcaatagaaacgaccagagagtctttattcaggctggaggtgatttcgctaagcactttaatcatgatgccaggtttaacggcagcaaaaatgatgtcggcgatttgcgccacttcttgcgccgattctgcggcgttgatgccgaactggtcatgcagggcggcgactttatccggggagggggtgtatacccagatttgccctggaagcacctgaccgctggcaatcagaccgccgagaatggcttttcccatattgccgcagccaataaaaccgattttcttttccattgcctcactcctgccgtgaaattcattgttttgataatcgctggcagaagcataaacagaactatgccggaaggcaaaagcgcgacacaatagaggattacccaacaaaggatgactttatgacaatttgggtggatgccgacgcgtgtcccaatgtaattaaagagattttgtatcgcgcggcggaacgtatgcagatgccgctggtactggtagcaaaccagagtttacgcgtgccgccatcgcgatttattcgtacgctgcgcgtcgcggcaggtttcgacgttgccgataacgaaattgtccggcagtgtgaagcgggcgatttggtgatcaccgcagatatacctttggctgctgaagccatcgagaaaggcgctgcggcgcttaatccgcgcggcgaacgttacacgccagcgaccattcgtgagcgcctgacgatgcgcgattttatggataccttacgtgccagtgggatccagaccggcggaccagatagcctttcacaacgtgaccgccaggcctttgccgcggagctggagaagtggtggctggaagtgcaacgtagtcgtggctaaatgtaatttattatttacacttcattcttgaatatttattggtatagtaaggggtgtattgagattttcactttaagtggaattttttctttacaatcgaaattgtactagtttgatggtatgatcgctattctcatgacaccggctttcgccgcattgcgacctattggggaaaacccacgatgacacaacctctttttctgatcgggcctcggggctgtggtaaaacaacggtcggaatggcccttgccgattcgcttaaccgtcggtttgtcgataccgatcagtggttgcaatcacagctcaatatgacggtcgcggagatcgtcgaaagggaagagtgggcgggatttcgcgccagagaaacggcggcgctggaagcggtaactgcgccatccaccgttatcgctacaggcggcggcattattctgacggaatttaatcgtcacttcatgcaaaataacgggatcgtggtttatttgtgtgcgccagtatcagtcctggttaaccgactgcaagctgcaccggaagaagatttacggccaaccttaacgggaaaaccgctgagcgaagaagttcaggaagtgctggaagaacgcgatgcgctatatcgcgaagttgcgcatattatcatcgacgcaacaaacgaacccagccaggtgatttctgaaattcgcagcgccctggcacagacgatcaattgttgattttcgagcgcctatacttaacgttcatcccgtgaaataaggaagaacgatgccaacgaaaccgccttatcctcgtgaagcatatatagtgacgattgaaaaaggaaagccaggacagacggtaacctggtaccaactcagagccgatcatcctaaaccagactcgttgatcagtgaacatccgaccgctcaggaagcgatggatgcgaaaaaacgctatgaggaccctgacaaagagtgaccgcatcagactgctcggaagggattctgagtgccactacaagggatctgcgtcacatttttcataattcatgtttttctaataattagaatattaaacaataacaatccattactggaatcatttggaatctttacattatgccgtgcacgtctgctgctacgctttttgtcatttgtagcacaagtaagtgtcagcagtggtgcttcacacttgcccggtaattaacgacgaaagaaaagtaaggtggatgaacaatgagtgcgtcgttggcgatcctgaccatcggcattgtacctatgcaggaagttttgccgctcctgacggaatacattgacgaagataatatttcccatcatagcctgctggggaagttaagtcgtgaagaagtgatggcggagtacgcgccagaagcaggcgaagacaccattctcacattattaaatgacaaccagctggcccatgtttcgcgtcgcaaagtggagcgtgacctgcaaggtgtggttgaagtgctcgataatcagggttatgacgtcattttattaatgagtacagcaaacattagtagtatgactgcgcgtaatacgatctttcttgagccgtcgcgaatattgcctccactggtttcctctattgttgaagatcatcaggtgggggttatcgttccggttgaggagatgctgcccgttcaggcgcaaaaatggcaaattttgcagaaatcgccggtattttcattgggtaaccccattcatgattcagaacaaaaaatcattgatgccgggaaagaattactggcaaaaggggctgatgtcatcatgctggattgtttaggatttcaccaacgtcatcgcgatttactgcaaaaacagctcgatgttcctgtcttgctgtctaacgtattgattgcacggctggctgcggaattactggtgtaattttgcgtgacagccagcgcctctggcccctatagtgaagtagatgttcaactaccaaacagggccagtttatgcttcaaagtaatgagtacttttccggcaaagtgaaatcaatcggcttttccagcagcagcactggtcgcgccagcgtgggtgttatggttgaaggcgaatacaccttcagcaccgctgagccggaagagatgacggtaatcagtggcgcgctgaatgtgttactgcctgacgcgaccgactggcaggtgtatgaagccggttcggtgtttaatgttcccggtcacagtgagtttcatctgcaagttgccgaacccacctcttatctgtgccgctatctgtaattcctcgccttccccttgaacgggagggcatttttctgaaatatcctttctttagcccataataatatttcctttgctgcgattttttcaatttccgatatattcataatttatcaaggttgatataaatatcagtgaagatctccagatattgttgcggaactggctacgataaaagataaatcagatgatgaatggtggcgtgcattgctgcaaagtcgcaatgatcatttacgccaaacggcattgcgcaacgcacataccccggcgttgttgttaacgacattgactgagcctcaggatcggtcgctggctattaataatccacagctggctgccgatgtgaaaacggcgtggttaaaagaggatccatcattactcttatttgtcgaacaacccgatctttcgctgttacgtgatttagtgaaaaccggggcaacgcggaaaattcgcagtgaagcgcgtcaccggcttgaggaaaaacaatgacacaacgtccatggagcaagttacagcgtaaaacgcataatattgctgcgctaaaaattattgctcgccgtagcgaataattatatgcctggtgtggcttcgtacgccggataagacgcggcaggcgtcgcatccggcattaaaggaaaatcagcaattaacgttgtgcttcgccacctaatccttcaatcaggttttgaattaacgctgccagttcaccagtcatcaggatgaaatcggcatcaaaacgctgggcgaaatcttcacggtcgatatcttcgttttgatcgcgcagctcgtcgcagaacttcagacgcttgagcgaaccatcgtcgcacatcacaaactgaatgcgctgctgccagtcgagcgccagtttagtcaccacttttccggcttcaatgtgattggtgatctcttcgctggtcagatcttgtttcttcgcgcggatcacgccgccatcttccagcaacgatttcagctcggcttcatcaagcagctggaagccctgtgccgcactaccggagcgaacccattcggtcagcgtcagttcaatcgggttttccatgctcaatggtacaaccggtaacgaccccaggcttttacgcagtaatgccagcgtatcttccgcttttttggcactggcgcagtccaccataatcaaaccgttaaccgtgtcgatccacatcattgtctggctaaaacggctgaaagcacgcggcagcagagagtgcagcacttcgtctttcagcgaatctttttcggttttcttcagcttacgcgcctgttccgcttccagtttggcgattttcgcttccagcgcctgtttaatcaccggagacgggaggattttttcttctttgcgcgcgcagataacaatttgaccattggcaacgtgcgttaacgcatcgctgtgcgatcccatcggaggaacccagcccatcttcgccatgtcctggctgccgcatggggtaaatgccatcgaggctagctgtttttccatctcttctgcacgcagcgaaatctcgcggctaagacggtaaaccattaaatttttgaaccacagcatgataatttccacggccttgtcgttaaatttagcgggcatgataacgaattgtcggcggccttgcattgccaatccggttgtccgtctctacgctattgatattgaaaaaaataaggagagtaccgtgcgtataggtatcgatttaggcggcaccaaaactgaagtgattgcactgggcgatgcaggggagcagttgtaccgccatcgtctgcccacgccgcgtgatgattaccggcagactattgaaacgatcgccacgttggttgatatggcggagcaggcgacggggcagcgcggaacggtaggtatgggcattcctggctcaatttcgccttacaccggtgtggtgaagaatgccaattcaacctggctcaacggtcagccattcgataaagacttaagcgcgaggttgcagcgggaagtgcggctggcaaatgacgctaactgtctggcggtttcagaagcagtagatggcgcggcagcgggagcgcagacggtatttgccgtgattatcggcacgggatgcggcgcgggcgtggcattcaatgggcgggcgcatatcggcggcaatggcacggcaggtgagtggggacacaatccgctaccgtggatggacgaagacgaactgcgttatcgcgaggaagtcccttgttattgcggtaaacaaggttgtattgaaacctttatttcgggcacgggattcgcgatggattatcgtcgtttgagcggacatgcgctgaaaggcagtgaaattatccgcctggttgaagaaagcgatccggtagcggaactggcattgcgtcgctacgagctgcggctggcaaaatcgctggcacatgtcgtgaatattctcgatccggatgtgattgtcctggggggcgggatgagcaatgtagaccgtttatatcaaacggttgggcagttgattaaacaatttgtcttcggcggcgaatgtgaaacgccggtgcgtaaggcgaagcacggtgattccagcggcgtacgcggcgctgcgtggttatggccacaagagtaaaaaacgtaggcaattggcgcatcatgcctgatgcgacgcttgccgcgtcttatcaggcctacaaaaggtgccagaaccgtaggccggataaggcgttcacgccgcatccggcaataagtgctccgatgcctgatgcgacgcttgccgcgtcttatcaggcctgcaaaatgtgccagaaccgcgtagggcggataaggcgttcacgccgcatccggcaataagtaatgagcaccgagactataacctaccccagtggtttcgccagcaccggagtatccgccgcttgctggcgcttatagcgaccatacagcagcaacgacgacatcgcagcaaacgaaagcagggcggcaggcagcgccacgtaattatatgccagccccagcgtcagcatcatacctccgcaatatgcgccgacggcgctaccgaggttaaacgctatttgcccacctgcggcacctaataactctccgcctttggcgttttgtagtaacaatatttgtagcggtgctgaaagggcaaataatcccgcgcaacaaataaaagcaaaaataagcgacgttgttttcatgccgccgcagaaaaagagcatcagcagtgccagtacaattataaagtcagtcactgctgcaatgcgcagtggtgaataacgtcctgaaatcctgccacttagcatatttcccagcaccatccctagcccaactaacatcataataaaggtcatcgccgtttccgaaaaaccggaaataaacatcatgtatggctttacgtagctgaaccaggcaaacacacctgcgttgccaaacatcgtggcggcgaaaattaaccacggggccgggctgcgcaaaaagtgaaattgttcgcgcagatttcctttcgcctcgtcgcgaatatctggcacccaaaaatagaccgatgccatcaccgcaatattaaaaacagcgatcaataaaaaggtgtaacgccagctaaattcctgacttaaatacgttcccagcggaatgcccagcaaattggcgactgtcatcccggaaaccatccccgccacggcggcggtgacttttccgggtttgataatttttgataacacgatcgctccgacgccaaaaaatgcgccatgcggaaagccggataccagccgaccaatggcgagcatcaggtaagacgaagagagcgtgaacatggcgttgccaatgacgcacaacgccaccagaaacaacaagatatgtttgagtgagtagcggctggaaaagagtgcgatgattggcgcaccgaccaccacccccagtgcataatacgagatcatatgcccggcggcaggaatcgaaattcctacgttatgcgccagctccgtgagcacgcccataatgccaaattcggccatccccaaaccaaacgtgcccagagccaaagataaaatgacttttttcataccaccatcacaaccaccagaacggctaccaatcaccgtagccaataaagtgatagcttgcaggataacgaccagcaaggccaagagataattcgcccctctgtattcattatcctgctgaatagttatttcactgcaaacgtactttccagtttgctgtagcccaggccgttgatctttttcactttgatctgcaccggaatacgctctttcatcgcttctacgtggctaatcacaccgatggttttgccactggcgttcagggcatccagcgcatcaagggcggtatccagcgtttcgctatccagcgtgccaaaaccttcatcaaggaacagcgagtcaatacgtgttttatggctgaccagatccgaaagcgccagcgccagcgccagactaacgaggaaactttcgccgccggaaagggtacgggtatcgcgtaccgcatctgcctgccaggtatcaacaacctcgacttccagcgcctcgctggctttgcgctgtaacagatagcgcccgtgcagccgggtaagttgctgattagcgagatggactaaattatccagcgtcagcccctgggcaaacttgcggaatttatcgccctctttggaacctattagcgaattcagatatccccagtcctcaacctgctgcgtcatttgagcaatttgctgcattaaggtttgttgttgctgacggttatctgcatcctgcttcagctgctggcgaatctcgccttgactcgtggtgttttcacgcaacttttggtgagtttgcgctaactcttgctgaatctgctccaccgtcacagtgagagccaacccgtcgtcaggtcggtgttgttgatgctgtgccagcgtttctgctgtctgagtgaccagagtttgcgcctgacggcgctggttttccagattctgcttgagctgttccagctgcgttagtgtttgttcatccattagcgccgcaaggaacgcctgctgatcgtcaaagacgctggcctgtagcgcggtgtcaaactgcgcctgggctttttgcagactttgcgccgccagaacatcctgttgctgtaacgtctgctgctggctgtgtaatgcgagacattgttcatgtacctgccgccagttttccaataccacagtttcttcgcagtgcgggagttcatcactttgcggcaacgtttccagaatcggcgtcagctgctgaatacggttttgcagcgcggttaattcgttctggcgttgctgccagctctgcgcttcttgctgacgtgtcgccaaccagctctcttcttcatcttcctgtggcaatgtcagtgcataacccgtcaatgtcgttaaaagtagttgctggcgttgttcaatttgctgttgatactggataatttgctgattatgcgcggcaatctgcccttgtaattcatgccgttggctgagtaaccgcagctggcgttcgtgctcatcttgtgcatccagccacggttgaatatcgtccagtggctgcaaggtgatattgaggctggccgtgacggcttgccattgttgagtaagtgcttgctcatcttgtcggaggctttgcgcttcgttttcatcacgctgaagctgctttgttatggcgtccagttgcccacgtagcgtcgcaccttcttcaccgagctttttaacttcgttttccagcgccagtaatcgagactgattaacgccaggctccagcgcctgatacgcctcgaccgccgggtggctggtggaaccacaaagtgggcaaggctgacccgcctgtaactgtgcacgttgagcttccagcgttttgatgcgcgcttcctgctcgcaaatggttttcacatcggcaagttgctgcgtcttttctttataacgctggcgcatttcgttaagtgcggcgttacgttgcgtctgttcttgcgtgacattctggatagcgacctgtaactgcgccagacgtttttgttggggaacaatctgtccatgcagcgcgaccaggtgctgacgcagtgggcgttgctcagcatgttgcgccagggcggtagcaacttcatcggcggttaacgtcaacgtgatcgccgcaagcgcattaagtttttgctcagcatgggttaactgttgctgccattgccgcagatgctcgcgatcgctggtttgttgggagaactgcgcacgccaacccgccggttcgttgttccactgacggaagcggtcgtgttcctgtaaccaggtattcaggctttgttgctgctgctgtaattctgctgactgcttcgccgcgtggtggcgaatgctcgcgcgaagcgccattgtgctctgtaagcgagtatttacttcttcaatctgctggcgaatatgcgccagcgccgcgctgtgttctgcgatgcgttcccagtgtggacgaagatttcgtgccggttgtgccagactaagcgccgccagttgaggttgcgctttttcttcttcggctaacgcctgttgcaaggcctgctgacggcggctggcttcttgctgcaattcgtcctgacgcgttaaccagtttagcgattgttgttcttgctgctgcgcggtaattaactgtttttcttcgtcagtaagtacctgcaaactcgctgtcagcgattgcacttgttccggcgtgagcaacgtgacgccgctggcctgcgcttgcagcttctccagctctgtgcgggccgatttgtgctgctcaaaaaccatcgccgagatttgcccgtagatttcagtgccggttaactcctcgagcaattccgcgcgttctttgggtttggcattcaggaaggcagcaaattgcccctgcgaaagcagcatcgaacgggtgaagcgcccgtaatccagcccggttaacgtcgctgtcagttccagcttatctttcactttgtcggcgagaattttgccgtcggcgcagcgcgccagctctacgcgtggcacctgcaaattaccgtcgggttggttacgcgcccgattctggctccagaatgcacggtacgcttcacctttcacttcaaactccacctccgccagacattcggcggtatcgcgggtcatgagatcattttgcgattgtgaaacgttagagagacgcggagtttcgtgatacagcgccagacaaatggcgtccagcagggtggttttccccgcacctgttgggccggtaatagcaaacagcccgttgctggcgaacggctcgcgggtgaaatcaatcttccattcgccttttaatgagttcaggtttttcaggcgcaggctgagaattttcatgcttcgtgttctccggcgagggtatgcaacgtcgtggtgaaaagatgctgcagacgttgctgctgcgattcatccagttcttccagtgccagacggcgattgaacacctcttcgacgctgagttcgctgagggtttcacgctgttggctggctaacacacgctcgcgctgttcacgactccgacgtaccagcaatacttcgacaggcaatgattcggttaatgcctggattttgcgctgaatatcatgcagatactcatcagtagtgatttcgatatccagccagacaggtggctcctgcgatacatcgcgccactgttccagctgtgcggtaatcgacgccagatcgcctttcagcactgccatgggttgcgttaccggtacgttcaggttttccacgctctctaatttgccgtttgaaaatgtcaccagatggacatatttactcttaccgcattcatcaaaactcagtggaatgggggagccgcaatagcgaacatgttccatgccgccaataatctgtgcgcggtgaatatgcccgagcgcgatgtagtcggctggtggaaagttttgtgccggaaacgcgtccagcgtgccaatataaatgtcacgcacggcgtcacttttactggcccccacggtcgttaaatgtcccgtggcgatgatgggcagaggctgatcgccgcgcagtttgcaggcatcggcatagtgttgttggtaataatcggtaatcgctgccagtaaatgctgctgtttttcaataccgttaagccccgcctggctggtaataatgtcacgcggacgtaaaaacggaatggggcacagcactgcgcctggcgtcccgtcgcgacgaggcaagatttgcggcgcatgtccggcgctggcgaccacggtagtattgaggaacgccatgatatcgcgcgattcattcagcgtggcgaccgagtcatggtttcctgccagtaccaccagatgacagccagtttgctgtaaattgacaacaaaacggttgtataacgtgcgggcgtaactgggcggcgagccggtatcgaaaacatcaccggcaacaataatcgcatccacctgatgggtttgtgctgtctccagcagccagtcaagaaaagcctgatgttcagcttcgcggcttttactgtagaagttctggccgagatgccagtctgaggtgtgaaggatgcgcataacggttccctggcgaaaaagcatgggcgcgattatacccaaacagatgtgccatttgcttttttctgcgccacggaaatcaataacctgaagatatgtgcgacgagcttttcataaatctgtcataaatctgacgcataatgacgtcgcattaatgatcgcaacctatttattacaacagggcaaatcatggcgagacgtattctggtcgtagaagatgaagctccaattcgcgaaatggtctgcttcgtgctcgaacaaaatggctttcagccggtcgaagcggaagattatgacagtgctgtgaatcaactgaatgaaccctggccggatttaattctcctcgactggatgttacctggcggctccggtatccagttcatcaaacacctcaagcgcgagtcgatgacccgggatattccagtggtgatgttgaccgccagaggggaagaagaagatcgcgtgcgcggccttgaaaccggcgcggatgactatatcaccaagccgttttcgccgaaggagctggtggcgcgaatcaaagcggtaatgcgccgtatttcgccaatggcggtggaagaggtgattgagatgcagggattaagtctcgacccgacatctcaccgagtgatggcgggcgaagagccgctggagatggggccgacagaatttaaactgctgcacttttttatgacgcatcctgagcgcgtgtacagccgcgagcagctgttaaaccacgtctggggaactaacgtgtatgtggaagaccgcacggtcgatgtccacattcgtcgcctgcgtaaagcactggagcccggcgggcatgaccgcatggtgcagaccgtgcgcggtacaggatatcgtttttcaacccgcttttaacgccttgctcatcggacgcagagcagggcttatgatttcttaactggagtatcttacgtgctggaacggctgtcgtggaaaaggctggtgctggagctgctactttgctgcctcccggctttcatcctgggtgcattttttggttacctgccctggtttttgctggcatcggtaacaggactgcttatctggcatttctggaatttattgcgcctttcatggtggctgtgggtggatcgcagtatgaccccgccaccggggcgtggtagctgggaaccgctactatacggcttacaccagatgcagctgcgaaataaaaaacgccgccgtgaactgggcaatctgattaaacgctttcgtagcggcgcggagtcgctgcccgacgcggtggtgctgaccacggaagagggcggtattttctggtgtaacggtctggcgcaacaaattcttggtttgcgctggccggaagataacgggcagaacatccttaacctactgcgttacccggagtttacgcaatatctgaaaacgcgtgatttttctcgcccgctcaatctggtgctcaacaccgggcggcatctggaaattcgcgtcatgccttatacccacaaacagttgctgatggtggcgcgtgatgtcacgcaaatgcatcaactggaaggggcgcggcgtaacttttttgccaacgtgagccatgagttacgtacgccattgaccgtgttacagggttacctggagatgatgaatgagcagccgctggaaggcgcggtacgcgaaaaagcgttgcacaccatgcgcgagcagacccagcggatggaaggactggtgaagcaattgctgacgctgtcgaaaatagaagccgcaccgacgcatttgctcaatgaaaaggttgatgtgccgatgatgctgcgcgttgttgagcgcgaggctcagactctgagtcagaaaaaacagacatttacctttgagatagataacggcctcaaggtgtctggcaacgaagatcagctacgcagtgcgatttcgaacctggtctataacgccgtgaatcatacgccggaaggcacgcatatcaccgtacgctggcagcgagtgccgcacggtgccgaatttagcgttgaagataacggaccgggcattgcaccggagcatattccgcgcctgaccgagcgtttttatcgcgttgataaagcgcgttcccggcaaaccggcggtagcggattagggttagcgatcgtgaaacatgctgtgaatcatcacgaaagtcgcctgaatattgagagtacagtaggaaaaggaacacgtttcagttttgttatcccggaacgtttaattgccaaaaacagcgattaatccgcctttgtcatcttttattgccataagccagtcgatgctggcttattttctttgcagtcaaaatacgggcgttagattttacaacgattggtgattttttgttcgcatgattagccatgtctttttcacggaaatagtgttttatactggttggtgatttcttatcgctatatacctctggtttttagatccctccttgctttaaaacgttataagcgtttaaattgcgcttcaggtgctgtcatactgactgcattaacgcggtaaatcgaaaaactattcttcgccgcgcctggttgggagtatttcccgctaaaattgtttaaatataccgctgtatcatccccagggattggcacaaaaatttaacgttacaacaccacatccacaggcagtatgatttatgacccatcaattaagatcgcgcgatatcatcgctctgggctttatgacatttgcgttgttcgtcggcgcaggtaacattattttccctccaatggtcggcttacaggcaggcgaacacgtctggactgcggcattcggcttcctcattactgccgttggcctgccggtattaacggtagtggcgctggcaaaagttggcggcggtgttgacagcctcagcacgccaatcggtaaagtcgctggcgtactgctggcaacggtttgttacctggcggtggggccgcttttcgctacgccgcgtacagctaccgtttcctttgaagtggggattgcgccgctgacgggtgattccgcgctgccgctgtttatctacagcctggtctatttcgctatcgttattctggtttcgctctatccgggcaagctgctggataccgtgggcaacttccttgcgccgctgaaaattatcgcgctggtcatcctgtctgttgccgctattgtctggccggcgggttctatcagcacggcgactgaggcttatcaaaacgctgcgttttctaacggcttcgttaacggctatctgaccatggatacgctgggcgcaatggtgtttggtatcgttattgttaacgcggcgcgttctcgtggcgttaccgaagcgcgtctgctgacccgttataccgtctgggctggcctgatggcgggtgttggtctgactctgctgtacctggcgctgttccgtctggggtcagacagcgcgtcgctggtcgatcagtctgcaaacggcgctgctattctgcatgcttacgttcagcacacctttggcggcggcggtagcttcctgctggcggcgttaatcttcatcgcctgcctggtaacggcagttggcctgacctgtgcttgtgcagaattctttgcccagtacgtaccgctctcttatcgtacgctggtgtttatcctcggcggcttctcgatggtggtttctaacctcggcttaagccagctgatccagatctccgtaccggtgctgaccgctatttatccgccgtgtatcgcactggttgtattaagttttacacgctcatggtggcataattcgtcccgcgtgattgctccgccgatgtttatcagcctgctttttggtattctcgacgggatcaaagcatctgcattcagcgatatcttaccgtcctgggcgcagcgtttaccgctggccgaacaaggtctggcgtggttaatgccaacagtggtgatggtggttctggccattatctgggatcgcgcggcaggtcgtcaggtgacctccagcgctcactaaatcactgaacatttgttttaaccacggggctgcgatgccccgtggttttttattgtgttgatgggttaggaattgatggaaagtaagaacaagctaaagcgtgggctaagtacccgccacatacgctttatggcactgggttcagcaattggcaccgggctgttttacggttcggcagacgccatcaaaatggccggtccgagcgtgttgttggcctatattatcggtggtatcgcggcgtatatcattatgcgtgcgctgggggaaatgtcggtacataacccggccgccagctctttctcgcgttatgcgcaggaaaacctcggcccgctggcaggttacattaccggctggacctactgctttgaaatccttattgtcgccatcgccgatgtgaccgcttttggtatctatatgggtgtctggttcccgacggtgccgcactggatttgggtactgagcgtggtgctgatcatttgcgccgtaaacctgatgagcgtgaaggtattcggtgagctggaattctggttctcgttctttaaagtcgccaccatcatcatcatgattgtcgccggtttcggcatcatcatctgggggattggcaacggcgggcaaccgaccggtattcataacctgtggagcaacggcggcttcttcagtaacggctggcttggcatggtaatgtcgttgcaaatggtgatgtttgcttacggtgggatcgaaattatcgggattaccgccggtgaagcgaaagatcctgagaaatcgataccgcgtgcgattaactccgtgccgatgcgtattctggtgttctacgtcggtacgctgttcgtcattatgtctatctacccgtggaatcaggttggcactgccggtagcccgttcgtgctgacgttccagcatatgggcattacctttgccgccagcattcttaactttgttgtgctgactgcttcgctgtcggcaattaacagtgatgtatttggcgtaggccgtatgctccacggtatggcagagcagggcagcgcgccgaaaattttcagcaaaacgtcgcgtcgcggtattccgtgggttacggtgctggtgatgactaccgcgctgctgtttgcggtgtatctgaactacatcatgccggaaaacgtcttcctggtgatcgcttcgctggcaaccttcgccacggtgtgggtgtggattatgatcctgctgtcgcaaattgccttccgtcgccgtttgccgccagaagaagttaaggcgctgaaatttaaagtgccgggtggggtagcaacgaccatcggcgggctgattttcctgctctttattatcgggttgattggttatcacccggatacgcgtatctcgctgtatgtcggtttcgcgtggattgttgtgctgttgattggctggatgtttaaacgccgccacgatcgtcagctggctgaaaaccagtaatccttgcgttctgtaagccggttcaggaggaaatcctgatccggctattccgaaagttatccgcccccgtcctcctcccccaaatatccttcagatgatgagtgatcctgcattaggctatggcaaggtgatcagattttcatcacaggggaattatgatgttaaatgcatggcacctgccggtgcccccatttgttaaacaaagcaaagatcaactgctcattacactgtggctgacgggcgaagacccaccgcagcgcattatgctgcgtacagaacacgataacgaagaaatgtcagtaccgatgcataagcagcgcagtcagccgcagcctggcgtcaccgcatggcgtgcggcgattgatctctccagcggacaaccccggcggcgttacagtttcaaactgctgtggcacgatcgccagcgttggtttacaccgcagggcttcagccgaatgccgccggcacgactggagcagtttgccgtcgatgtaccggatatcggcccacaatgggctgcggatcagattttttatcagatcttccctgatcgttttgcgcgtagtcttcctcgtgaagctgaacaggatcatgtctattaccatcatgcagccggacaagagatcatcttgcgtgactgggatgaaccggtcacggcgcaggcgggcggatcaacgttctatggcggcgatctggacgggataagcgaaaaactgccgtatctgaaaaagcttggcgtgacagcgctgtatctcaatccggtgtttaaagctcccagcgtacataaatacgataccgaggattatcgccatgtcgatccgcagtttggcggtgatggggcgttgctgcgtttgcgacacaatacgcagcagctgggaatgcggctggtgctggacggcgtgtttaaccacagtggcgattcccatgcctggtttgacaggcataatcgtggcacgggtggtgcttgtcacaaccccgaatcgccctggcgcgactggtactcgtttagtgatgatggcacggcgctcgactggcttggctatgccagcttgccgaagctggattatcagtcggaaagtctggtgaatgaaatttatcgcggggaagacagtattgtccgccactggctgaaagcgccgtggaatatggacggctggcggctggatgtggtgcatatgctgggggaggcgggtggggcgcgcaataatatgcagcacgttgccgggatcaccgaagcggcgaaagaaacccagccggaagcgtatattgtcggcgaacattttggcgatgcacggcaatggttacaggccgatgtggaagatgccgccatgaactatcgtggcttcacattcccgttgtggggatttcttgccaataccgatatctcttacgatccgcagcaaattgatgcccaaacctgtatggcctggatggataattaccgcgcagggctttctcatcaacaacaattacgtatgtttaatcagctcgacagccacgatactgcgcgatttaaaacgctgctcggtcgggatattgcgcgcctgccgctggcggtggtctggctgttcacctggcctggtgtaccgtgcatttattacggtgatgaagtaggactggatggcaaaaacgatccgttttgccgtaaaccgttcccctggcaggtggaaaagcaggatacggcgttattcgcgctgtaccagcgaatgattgcgctgcgtaagaaaagtcaggcgctacgtcatggcggctgtcaggtgctgtatgcggaagataacgtggtggtatttgtccgcgtgctgaatcagcaacgtgtactggtggcaatcaaccgtggcgaggcctgtgaagtggtgctacccgcgtcaccgtttctcaatgccgtgcaatggcaatgcaaagaagggcatgggcaactgactgacgggattctggctttgcctgccatttcggctacggtatggatgaactaacgttttataacgccttgcgtgacgcctgcgccatcatccgcggataaaactgccagaagcgggtttcgagggcgtcataatgagcgtctaaatcgtaccaggagtcacgcagggcatccagacgtgggcggcggcttgccatgccgtttaacacgttctggatgaaatccatatcgcgatagcgcaccagccactgctctgaccacaagtaattgttcagattgataaaacgtggcggtgagtccggcaaaatcgtcatcacttgctcgcgggcataacagacaaattcctgtagcggaaagtccggcgacagctgcgaccagtggcgggaaagaaagtgatcccacatgacatccagcgtaataggcgcaacgcggcgcgtttcactacgaaaccactcccgtgcttcgcggacttccggcagattgtcagtcaatacgtcgatacgtcgatgcatatgaatgccagccacgacgtcgggcggaaaactttcttcaggatttccgcgtacgaaatcagccagtaaattgccggaaagcgagctttccgcgagatgggctaaatgcaggtgagctaaaaaattcatcgattatattctatccaaaagggggtaaaggttgcagggagagcgccccggcactagactacccgcctcttattttagtctgagtcagtgtcatgcgcgttaccgatttctcctttgaattgcccgaatccctgattgcccactatcccatgcctgaacgcagtagctgtcgtttactgtcgctggacgggccgacgggcgcgctgacgcacggtactttcaccgatttacttgataagctcaaccccggcgatcttctggtttttaataatacccgcgtgatcccggcgcgcctgtttgggcgtaaagccagcggcggcaagattgaagtgctggttgaacggatgctcgacgacaaacgcattcttgcgcatattcgcgcctcgaaagcgccaaaacctggcgcagaactgctgctgggcgatgacgaaagtattaacgcaacaatgaccgcgcgccacggcgcactgtttgaagtcgaatttaatgatgaacgctcggtgctggatattctcaacagcatcggccatatgccgctgccgccgtatatcgaccgtccggacgaagacgctgaccgcgaactttatcaaaccgtttatagcgaaaaaccgggcgcggttgcagccccgaccgcaggtctgcattttgacgagcctttgctggaaaaattgcgcgccaaaggcgtggagatggcgtttgtgacgttgcacgttggtgcgggcaccttccagccggtgcgcgtcgacaccattgaagatcacatcatgcactcggaatacgctgaagtaccgcaggatgtggtagacgcggtactggcggcgaaagcgcgcggtaaccgggtgattgcggttggcaccacttcagtacgttcgctggaaagcgcggctcaggcagcgaaaaacgatctcattgaaccgttcttcgacgatacccaaatctttatctatccgggcttccagtacaaagtggtcgatgcgctggtgacgaacttccacttgccagagtcgacgctgattatgctggtttcggcctttgccggttatcaacacaccatgaacgcctataaagcagcggtagaagagaaatatcgcttttttagttacggtgatgcgatgtttatcacgtacaatccgcaggcaattaatgagcgcgtcggggagtaattccgcggcgctggtttaaaacgttggactgtttttctgacgtagtggagaaaaaatgaaatttgaactggacaccaccgacggtcgcgcacgccgtggccgcctggtctttgatcgtggcgtagtggaaacgccttgttttatgcctgttggcacctacggcaccgtaaaagggatgacgccggaagaagttgaagccactggcgcgcaaattatcctcggcaacaccttccacctgtggctgcgcccgggccaggaaatcatgaaactgcacggcgatctgcacgattttatgcagtggaaggggccgatcctcaccgactccggcggcttccaggtcttcagccttggcgatattcgtaaaatcaccgaacagggcgtgcacttccgtaacccgatcaacggcgatccgattttcctcgatcctgaaaaatcaatggagattcagtacgatcttggttcggatatcgtcatgatctttgatgagtgtacgccgtatcctgctgactgggattacgcaaaacgctccatggagatgtctctgcgttgggcgaagcgtagccgtgagcgttttgacagtctcggaaacaaaaatgcgctgtttggtatcatccagggcagcgtttacgaagatttacgtgatatttctgttaaaggtctggtagatatcggttttgatggctacgctgtcggcggtctggctgtgggtgagccgaaagcagatatgcaccgcattctggagcatgtatgcccgcaaattccggcagacaaaccgcgttacctgatgggcgttggtaaaccagaagacctggttgaaggcgtacgtcgtggtatcgatatgtttgactgcgtaatgccaacccgcaacgcccgaaatggtcatttgttcgtgaccgatggcgtggtgaaaatccgcaatgcgaagtataagagcgatactggcccactcgatcctgagtgtgattgctacacctgtcgcaattattcacgcgcttacttgcatcatcttgaccgttgcaacgaaatattaggcgcgcgactcaacaccattcataaccttcgttactaccagcgtttgatggcgggtttacgcaaggctattgaagagggtaaattagagagcttcgtaactgatttttaccagcgtcaggggcgagaagtaccacctttgaacgttgattaatattaataatgagggaaatttaatgagcttttttatttctgatgcggtagcggcaacgggtgcaccggcgcaaggtagcccgatgtctttgattttgatgctggtggtattcggtctgattttctatttcatgatcctgcgtccacagcagaagcgcaccaaagaacacaaaaagctgatggactccattgccaaaggtgatgaagttctgacgaacggtggcctggttggtcgcgtaaccaaagtagcggaaaacggctacattgctatcgcgctgaatgacaccactgaagtagttattaaacgtgacttcgtagctgccgtcctgccgaaaggcaccatgaaggcgctgtaattaaaatttttccctaagggaattgccgtgttaaaccgttatcctttgtggaagtacgtcatgctgatcgtggtgattgtcatcggtctgctgtatgcgcttcccaacctgtttggtgaggatccggctgttcagatcactggtgcgcgcggagtcgccgccagtgagcaaacgctgatccaggtccagaaaacgttacaagaagaaaaaataactgctaagtctgtggcactggaagagggcgctattcttgcgcgcttcgactccactgacacccagttgcgcgctcgtgaagcattaatgggcgttatgggtgacaaatacgtcgtggcgcttaaccttgccccggcaacgccgcgctggctggcagctattcacgctgagccgatgaagctcggccttgacctgcgtggcggcgttcacttcctgatggaagtggatatggacaccgcgcttggcaaactccaggaacaaaatatcgatagcctacgcagtgacctgcgcgaaaagggcatcccgtataccactgttcgtaaagaaaacaactacggcctgagcatcactttccgcgatgctaaagctcgtgatgaagccattgcgtatctgagcaagcgccatccggacctggtgattagcagccagggcagcaaccagctgcgtgcggtaatgagcgatgctcgtctgagtgaagcgcgtgaatatgcggtgcagcagaacattaatatcctgcgtaaccgtgtaaaccaacttggcgtggcggagccggtggttcagcgtcagggtgctgaccgtatcgttgttgaactgccaggtattcaggacactgcgcgtgcgaaagagattctgggtgcgacggcaacgctggaattccgtctggtaaacaccaacgttgaccaggccgctgcggcatccggtcgcgtaccgggcgactctgaagtgaaacagacccgcgaaggtcagccagttgtgctgtacaaacgcgtaattctgaccggtgaccatatcaccgactccacttccagccaggacgaatacaaccaaccgcaggttaacatctcgctcgatagcgctggtggtaacatcatgtctaacttcactaaggacaacatcggcaaaccgatggcaaccctgtttgtggagtacaaagacagcggtaagaaagatgcaaatggtcgtgcggttctggtgaaacaggaagaggtgattaacatcgccaacatccagtctcgtctgggtaacagcttccgtatcaccggcatcaacaacccgaacgaagcccgtcagctgtcactgctgctgcgtgccggtgcgttgatcgcgccgattcagattgttgaagaacgtaccattggcccaaccctgggtatgcagaacattgaacaggggctggaggcttgccttgccggtctgctggtttctattctgttcatgatcatcttctataagaagtttggtctgattgcgaccagtgctctgattgccaacttgatcttaatcgtcggcattatgtcgctgttgccaggcgcaacgctgagtatgccaggtatcgcgggtatcgtcttaacccttgcggtggcggtcgatgcgaacgtactgatcaacgaacgtattaaagaagagttgagcaacggacgtactgttcaacaggcaattgatgaaggttatcgtggcgcattcagttctatcttcgatgcgaacatcaccacgctgattaaagtcatcatcctgtacgcagtgggtaccggggcaattaaagggttcgcgattactaccggtatcggtgtggcgacgtcgatgtttaccgcgattgtcggtacgcgtgccatcgtaaacctgctatatggcggcaagcgcgtcaagaagctgtcaatctgaggagtgcgatgtggcacaggaatatactgttgaacaactaaaccacggccgtaaagtctatgactttatgcgctgggactactgggctttcggcatctctggtctgctgttaatcgctgctatcgttattatgggcgtgcgcggctttaactgggggctggatttcaccggtggtacggttattgaaattacgctcgaaaaaccggctgaaattgacgtaatgcgtgatgcattgcaaaaagccggttttgaagagccgatgctgcaaaactttggtagcagccatgacatcatggtccgtatgccgcctgctgaaggcgaaaccggcggtcaggtgttgggcagccaggttctgaaggtgattaacgaatccaccaatcagaatgcagcagtgaagcgtattgagttcgtcggtccgagcgtgggggcagaccttgcgcaaaccggtgcgatggcgttgatggcagcgctgctgtctatcctcgtgtacgtaggtttccgctttgagtggcgactggcggcaggggtggttattgcgctggcgcacgacgttatcattacgctgggtattttgtcgttattccatatcgagattgacctgaccattgtggcatcgttgatgtcggttatcggttactcgcttaacgacagtatcgtggtatcggaccgtattcgtgaaaacttccgcaagatccgtcgcggtacgccttacgaaatctttaacgtgtccttgacccagacgctgcaccgtaccttgatcacatccggtactaccttgatggttatcctgatgctgtacctcttcggtggtccggtactggaaggcttctcgctgaccatgcttatcggtgtttccatcggtactgcatcttccatctatgtggcatctgcgttggctctgaaactgggtatgaagcgcgaacacatgttgcagcagaaagtggaaaaagaaggggcggatcagccgtcaattctgccgtaatcaagttcccgttgatgttgaaaatcccggtcagaagatcgggattttttttgatgtatggagattgcgaaaatccccgcatcttgggaaactgcgcgtaaccctacatttcatccaggtaacttttcatggctatcatcccaaaaaactatgcgcggttagaaagcggctatcgcgaaaaagcattaaaaatctatccgtgggtctgcggtcgctgttcccgcgagtttgtttattccaacctgcgtgaacttaccgttcaccacattgatcacgaccataccaataacccggaagatggcagtaactgggaattgttgtgtctctattgccacgatcatgagcattcgaaatataccgaagcggatcagtatggtacgaccgttatcgcaggggaagatgcgcagaaagatgtcggtgaagcgaagtacaacccattcgctgacctgaaagcgatgatgaacaagaagaagtgattaaaacgtaaaattgcctgatgcgctacgcttatcaggcctacgttatttcagcaatatattgaatttacgtgcttttgttggccggacaaagcgtttacgccgcatccggcatgaacaaagcacacgttgttaacaatcagaaatgccgggaataaatcccggcattttcataatcagaagttgtaacctactaccaggtaaccaccccagccggtagagcgaacgttgaagttgccgttgccgaagttcagttctgcatcgtcgttccactgaccaccgtcgtgccagtaacgagctacgacagagtagtgccagtgatcgtagttcagagccagaatatggctggaagcgatagagttattagtacgggtcttaataccgttgattgcgttaccgctgtcatcccctaaatcggaaccccagtcgaagttggtgaagccgatgtagctcagctgaccgccccacagatcggtaatcggcacaaagtatttaattttgaaacggtaaccgtcccactcgttttcgttcgctgcgccatagttctgccactggtatttcgcatagacgttcatggacaggctcatcggcaggccagtgtcgatatcggtacccagacccatgtaccaggtgctctggcgaccatctttattacgacccatgtcgtaaatgtagttgttcgcgaagtaccactctttgaacggaccgaagctaaggtcagtattggtcagcttgtcgatggagaaacgtggttcgatttccataaacagcggagaaccgtggttccagatacctttagcatcggagttaccgccgaagaataccggcgcatccgcataaccatagaagtcgaaccagtcttttttagcgaatgcttcgtactcaaggtaggtatcgttgcggatctgcggtccgaaacgggtgtgatagcttccgacaacgttaacgctctggtgccaccagtcggaaagatactgcggtttgtcgttttcagctgcgttgacagtaaaagacgaagagagcgccagtaccgcaccggctgccagtaatgtttttttcatatgtatgccactgtttgaaaatcccttgcgggagtgaaaaaggcgcaaattgcgtttctaaatatttcgtatacagaggagcctattataaaaatcattgctcacaaaaatatgtttcgtttcacagttctatcatttacgtaatcgattgcgttcacgtttacacacattcgggcggggattgtactgactttcgcccttgttgcaaacttttactatcaatccaggtgatgtaagcagagtaacaaaatgacggggaaagatgttgcgggacgcacaaaatcgtcccgaaatacgtttactgcataacaggttgaatgtcgtggatacgtacaaagcctaactgatccacagaaatcccctttaactgtaacggaatatcaacatcgctgggggcgaggacgctggcaggggcattaatcaattgattctgcacattgatttcctgaaagttgtctattgttccctgaatttgcccatattcaacagttccgctgaatgcgggcaagggatcattcgactcaccctgaatacgtagtgtaagggtggtgccatctgcatcaggcgtaatattcaccagcgacatacgtaaagtaccgatctggctttccagtcttgccggtgttttcgctccaggcagaaggtaaaccccactgctggattttgcattcagcctgttttgctgagtgattttgactgtttcttgattgagttgcgtcatctcctggttcagcgtgctgacgctgtgtttcatctgtcgcacttcactttgctgcacacaggcgctaaggctgaacaggcttcccagcaggagcagtcgaaaaacgttagtattcataggtcgtccctttctcgtcgcaattagcctaatggtagagggtaaaagcagcgaaagcatcgatcctttatctcaaaagcgttgcgcctttgttgtatcgtcagttcagggtaaaatagatttccgttaaccacctggtcaggacgccgtatgcattgcccattctgtttcgccgtggacactaaggtaattgactctcgtctcgtgggcgagggttcatccgtacgccgccgtcggcagtgtctggtgtgtaatgaacgtttcaccacctttgaagtggcggagctggttatgccgcgtgttgtaaaaagcaacgacgtgcgtgaaccgtttaatgaagagaaattgcgtagcggaatgctgcgggcgctggaaaaacgtccggtgagttccgatgacgtcgaaatggcaatcaatcatattaaatcgcagctgcgcgccaccggtgagcgcgaagtgccgagcaagatgattggcaatctggtgatggagcaattgaaaaagctcgataaagtcgcctatatccgttttgcctctgtctaccgcagtttcgaagatatcaaagaatttggcgaagagatcgcgcgcctggaggactaagccgtgcaggacgagtattacatggcgcgggcgctaaagctggcgcaacgaggacgttttaccacgcatcccaacccgaatgtcgggtgcgtcattgtcaaagatggcgaaattgtcggtgaaggttaccaccaacgtgcgggtgaaccacatgccgaagtacacgcgttgcgtatggcgggtgaaaaagccaaaggtgcgaccgcctatgtcacactcgaaccctgtagccatcatggtcgtacgccaccgtgctgtgacgcactcatcgccgctggcgtagcgcgcgtggttgcctcgatgcaagatcctaacccgcaggtcgctgggcgtggactttaccgtctgcaacaggctggcattgacgtcagccacggcctgatgatgagtgaagccgagcaattgaataaaggctttctcaagcggatgcgcaccggctttccttatattcagttaaaacttggcgcatcgcttgatggtcgcacggcgatggcgagcggcgaaagccagtggatcacttcgccccaggcgcggcgtgatgtacaactactgcgcgcgcaaagtcatgccattttaaccagcagcgccacggtgctggcggatgatcctgccttaacggtgcgttggtctgaactggatgaacaaactcaggcgctctatccgcaacaaaatctccgtcagccgatacgtattgtgattgatagccaaaatcgcgtgacgccggtacatcgcattgtgcagcagcccggcgaaacctggttcgcgcgtacgcaggaagattctcgtgagtggccggaaacggtgcgtaccttgctgattccagagcataaaggtcatctggatctggttgtactgatgatgcaactgggtaaacagcaaattaacagcatctgggtggaagcggggccaacgctcgctggcgcattgctgcaggcgggtttagtcgatgagctgattgtctatatcgcacctaaactattaggcagcgacgcccgcggattatgcacgctgccagggcttgagaaattagccgacgccccccaatttaaattcaaagagatacgtcatgtaggcccggatgtttgcctgcatttagtgggtgcatgatctcccggctcgaaagggaagcagcgcacgaaatattatgctaaaatccgcccccctgcggggccatactcgaacccgaaggaagaaaatgaacattattgaagctaacgttgctaccccggacgctcgcgtcgccatcaccatcgcgcgtttcaacaactttatcaatgacagcctgctggaaggtgcaattgacgcactgaaacgtatcggtcaggtaaaagatgaaaacattaccgttgtttgggtgcctggtgcctatgagctgccgctggcggcgggtgcactggctaaaaccggtaaatacgacgcggtgattgcgctgggtacggttattcgtggtggcactgcccactttgaatatgtcgctggtggtgcaagcaacggcctggcgcatgttgcccaggacagcgaaattccggttgcttttggggttctgaccactgaaagcattgaacaagcgatcgaacgtgctggcaccaaagctggcaacaaaggtgcagaagctgcactgaccgcgcttgaaatgattaatgtattgaaagccatcaaggcctgaaattagtaaggggaaatccgtgaaacctgctgctcgtcgccgcgctcgtgagtgtgccgtccaggcgctctactcctggcagttgtcccagaacgacatcgctgatgttgaataccagttcctggctgaacaggatgtaaaagacgttgacgtcctgtacttccgtgagctgctggccggggtggcgactaataccgcatacctcgacggactgatgaagccatacctgtcccgcctgctggaagaactgggacaggtagaaaaagcagtactgcgcattgcgctgtacgaactgtctaaacgtagcgatgtgccatacaaagtggccattaacgaagcgatcgaactggcgaaatcgttcggcgcagaagacagccataagttcgtcaacggcgtactcgataaagcagcacctgtgattcgccctaacaaaaagtgatatccaggccggtagattcacggaagaccgttccatgatcgccggccttttcttttttacctgctgaggcataacgtatggcatgtggcgagttctccctgattgcccgttattttgaccgtgtaagaagttctcgtcttgatgtcgaactgggcatcggcgacgattgcgcacttctcaatatccccgagaaacagaccctggcgatcagcactgatacgctggtggcgggtaaccatttcctccctgatatcgatcctgctgatctggcttataaagcactggcggtgaacctaagcgatctggcagcgatgggggccgatccggcctggctgacgctggcattaaccttaccggacgtagacgaagcgtggcttgagtccttcagcgacagtttgtttgatcttctcaattattacgatatgcaactcattggcggcgataccacgcgtgggccattatcaatgacgttgggtatccacggctttgttccgatgggacgagccttaacgcgctctggggcgaaaccgggtgactggatctatgtgaccggtacaccgggcgatagcgccgccgggctggcgattttgcaaaaccgtttgcaggttgccgatgctaaagatgcggactacttgatcaaacgtcatctccgtccatcgccgcgtattttacaggggcaggcactgcgcgatctggcaaattcagccatcgatctctctgacggtttgatttccgatctcgggcatatcgtgaaagccagcgactgcggcgcacgtattgacctggcattgctgccgttttctgatgcgctttctcgccatgttgaaccggaacaggcgctgcgctgggcgctctctggcggtgaagattacgagttgtgtttcactgtgccggaactgaaccgtggcgcgctggatgtggctctcggacacctgggcgtaccgtttacctgtatcgggcaaatgaccgccgatatcgaagggctttgttttattcgtgacggcgaacctgttacattagactggaaaggatatgaccattttgccacgccataaagatgtcgcgaaaagtcgcctgaagatgagtaatccgtggcatctacttgctgtcggattcggaagtggattaagcccgatcgttcctgggacgatgggctcgctggcagcgattccgttctggtatctgatgacctttttgccctggcagctctactcgctggtggtgatgctggggatctgtatcggcgtctatctttgtcatcaaacggcgaaagacatgggtgtgcacgatcatggcagcattgtctgggacgaatttattggtatgtggatcacgctcatggcgctgccgaccaatgactggcagtgggttgccgccgggtttgtgattttccgtattctggatatgtggaagccgtggccgatccgctggtttgatcgcaatgtgcatggcggcatggggatcatgatcgacgatattgtcgccggggtgatttccgcaggcatcctgtattttatcggtcatcactggccgctgggtattctgtcgtagttgtgcaccgatgcctgatgtgacgcttgtcacgtctcatcaggcctggactcttatttaaatcctacgacaggatgcggtttatacggcgtttccagttcggcaatctgttccggcttcaaagtgatatccaccgcgttcaatagctcatcaagctgttcttcgcgcgaagttccgataatcggtgcggcaatgcccggtttactcaacaaccaggccagcgcaacttgtgctcgtgtcgcccccagttcttcactgacgcctgttaaccgctctgcgatctgcgcgtcattttcatcgctttctttatagagatttttccccacctcatcagacaccagtcgtgcggtagtttctccccacggacgcgtcagacggccccttgccagcgggctccatggaattaccgccacgccctcctgataacacagtggtagcatctcgcgctcttcttcacgataaatcagattgtagtgatcctgcatactgacaaactgcgcccagccgtgctgtttttggagttccagtgcctgagcaaactgcgaagcgtgcattgatgacgcgccgatataacgcgctttcccggcttttaccacgtcgttgagggcttccagcgtctcttcgatcggcgtgttgtaatcccagcgatgaatttgcaggatatcgacataatccatgccgagacgtcgcaggctgtcgtcgatagagcgcaaaatttgcgcacgggataatccttccggtaaatcaccaacgcgatggaacactttggtcgcaacgaccacgtcttcacgacgggcgaaatcccgcagtgcgcgaccgacgatctcttcgctgctgccgtcagaataactgttggcggtatcaaagaaatttatgccgccttccagtgcacgtttaattatgggacggctgctttcttccggcagtgtccatgcgtgattaccgcgatctggctcgccaaaggtcatacagccgaggcaaagtcgggaaacgcgaaggtcggtttttcctaaggggttgtattgcatgctgccactcctgctatactcgtcatacttcaagttgcatgtgctgcggctgcattcgttcaccccagtcacttacttatgtaagctcctggggcttcactcgtttgccgccttcctgcaactcgaattatttagagtctatgaataatttcttaagcatagcaggagtggagtagggattatgccagccaggccttgattttggcttccataccagcggcatcgaggccgagttcggcgcgcatttcttcctgagttccttgcggaataaagaagtccggcaggccaatgttcagcacgggtactggtttacgatgggccatcagcacttcgttcacgccgctgcctgcgccgcccataatggcgttttcttctacggtgaccagcgcttcatggctggcggccatttccagaattaacgcttcatcaagcggtttcacaaaacgcatatcgaccagcgtggcgttcagcgattcggcgactttcgccgcttctggcatcagcgtaccaaagttaaggatcgccagtttctcgccacgacgcttcacaatgcctttgccaattggtagtttttccagcggcgtcagttccacgccgaccgcgttgccacgcgggtagcgcaccgctgacgggccatcgttatagtgatagccggtatagagcatctggcgacattcgttttcatcgctcggggtcataatgaccatttccggtatgcagcgcaggtaagagagatcaaaagcaccctgatgggtttgaccgtcagcaccaacaatgcccgcgcggtcgatggcgaacaggaccggaagcttttgaatcgccacgtcatgcagcacctgatcataggcgcgttgcaggaaagtggagtaaatcgcgacaatgggtttgtacccaccaatcgccagacccgcagcaaaggtcaccgcgtgttgctcggcaattgccacgtcgaagtagcgatccgggaatttacgtgaaaactcgaccatgccggaaccttcacgcatcgccggagtaatcgccatcagcttgttgtctttcgctgccgtttcgcacaaccagtcgccaaagatttttgaatagctcggcaaaccgccgctacttttcggcaaacaaccgctggagggatcaaatttaggcacggcgtggaaagtgatcgggtctttttctgccggttcataaccacgaccttttttggtcatgatatgcaggaactgcgggcctttcaggtcgcgcatgttctttagcgtggtgataagccccagcacatcgtgaccgtccaccgggccgatgtagttaaagcccagctcttcaaacaacgtgccaggcactaccatgcctttaatatgttcttcggtgcgtttgagcagctctttaattggcggcacgccagagaaaacttttttcccgccttcgcgcagtgaagagtaaagcttaccggaaagcagctgtgccagatggttgttgagcgcgccgacattttcggaaatcgacatttcattgtcgttgagaatcaccagcatatcaggacggatatcgcccgcgtgattcatcgcttcaaacgccatgcctgcggtaatcgcgccatcgccaatgacacagacggtgcggcgatttttgccttctttttcggcagcaaccgcaataccaattccggcactgatggaggttgatgaatgcccgacgcttaatacgtcatattcgctttcgccgcgccacgggaacgggtgcagaccgcctttctgacggatggtgccgattttgtcgcggcgtccggtcaaaattttatgcggataagcctgatgccccacatcccaaatcaattggtcaaacggggtgttgtagacatagtgcagcgccacggtcagttcgaccgtgcccagcccggaggcgaagtgcccgctggaacggctcacgctgtcgagtaaatagcggcgcagttcgtcgcagagtttcggtaaactctctttcggcaacagtcgtaactcctgggtggagtcgaccagtgccagggtcgggtatttggcaatatcaaaactcatcaggggcctattaatacttattgtttatttattacgctggatgatgtagtccgctagcgcttccagtgccgaggtatcgagtgactgttcagccagttgtttcagcgactgacgggcatcgtcgatcagatcccgggctttcttccgggcttgctcaagacccagaagtgcagggtaggtacttttaccaagttgctggtcggcaccctggcgttttcccaacgttgcagtatctcccaccacatccaggatgtcatcctgaacctggaaggcaaggccgatgctctctgcatacttgtcgagtaccggcagagcacgacgtcctttatctccggcgcttaatgcaccaaggcgaacggcggcgcgaatcaatgcgccggttttatgacgatgaatacgctcaagcgcgtccagaggtacgtgtttgccttccgcgtctaaatctaatgcctgaccaccgcacattccggcaataccactggcgctcgccagttcagaaatcatcgaaattctgtcgcggtccgacacttccggcatatcggcatcgcttaaaatcgagaacgccagcgtttgtaaagcgtcgccagcgagaatcgcgtttgcttcgccaaacttcacatggcaggttggcaaaccgcgacgcagatcgtcatcatccattgccggtaaatcatcatgaattaatgagtaagcgtggatacactcaacggcggcagcgggtgcgtccagcgtgtttgtgctaacgccgaacatatgaccggtggcataaaccaggaaaggtcgcaggcgcttaccacctaataatgcgccatactgcatggtttcgaccacgggagtgttctgaaagggcagtggggcgataaaacggctcagcgcctggttggcctgcttaacgcaggcttcgagttgctgcggaaagtccattactcattgtccggtgtaaaaggggttagagaggcgtcttcattgtcagacagcagaatttgtacgcgctgttcggcttgttgtaatttggcctgcccctgacgtgccagctgcacgccgcgttcgaactcgttcagcgcctcttccagcggcaggtcgccactttccagacgggttacaatctgttccagctcgctcagcgccttttcaaagctggcgggcgcctcatttttcttcggcataatgaatgtctgactctcaatatttttcgccccgtcatggtaacggactcagggcaaatagcaaataacgcgcaatggtaaggtgatgtgcacagcaaagcgatgttagtggtatacttccgcgcctggatgcagccgcaggtgtgggctgctgtatttttccctatacaagtcgcttaaggcttgccaacgaaccattgccgccatgaagtttatcattaaattgttcccggaaatcaccatcaaaagccaatctgtgcgcttgcgctttataaaaatccttaccgggaacattcgtaacgttttaaagcactatgatgagacgctcgctgtcgtccgccactgggataacatcgaagttcgcgcaaaagatgaaaaccagcgtctggctattcgcgacgctctgacccgtattccgggtatccaccatattctcgaagtcgaagacgtgccgtttaccgacatgcacgatattttcgagaaagcgttggttcagtatcgcgatcagctggaaggcaaaaccttctgcgtacgcgtgaagcgccgtggcaaacatgattttagctcgattgatgtggaacgttacgtcggcggcggtttaaatcagcatattgaatccgcgcgcgtgaagctgaccaatccggatgtgactgtccatctggaagtggaagacgatcgtctcctgctgattaaaggccgctacgaaggtattggcggtttcccgatcggcacccaggaagatgtgctgtcgctcatttccggtggtttcgactccggtgtttccagttatatgttgatgcgtcgcggctgccgcgtgcattactgcttctttaacctcggcggcgcggcgcatgaaattggcgtgcgtcaggtggcgcattatctgtggaaccgctttggcagctcccaccgcgtgcgttttgtcgctattaatttcgaaccggtcgtcggggaaattctcgagaaaatcgacgacggtcagatgggcgttatcctcaaacgtatgatggtgcgtgccgcatctaaagtggctgaacgttacggcgtacaggcgctggtcaccggcgaagcgctcggccaggtgtccagccagacgctgaccaacctgcgcctgattgataacgtctccgacacgctgatcctgcgtccgctgatctcttacgacaaagagcacatcatcaacctggcccgccagattggcaccgaagactttgctcgcacgatgccggaatattgtggtgtgatctccaaaagcccgacggtgaaagcagttaaatcgaagattgaagcggaagaagagaagttcgacttcagcattctcgataaagtggttgaggaagcgaataacgttgatatccgcgaaatcgcccagcagaccgagcaggaagtggtggaagtggaaaccgtcaatggcttcggcccgaacgacgtgatcctcgatatccgttctatcgatgaacaggaagataagccactgaaagtcgaagggattgatgtggtttctctgccgttctataaactgagcaccaaatttggcgatctcgaccagaacaaaacctggctgctgtggtgtgagcgcggggtgatgagccgtctgcaggcgctctatctgcgcgagcagggctttaacaatgtgaaggtatatcgcccgtaatttgtggtttttacgtcgcatctggtcagatgcgacgtttgccgcatccgacactactcgtaataattataaatccctgccgccatcaccagttgtgatgccacttcatgggctttttcacgcccaaccaacaggtcgataattttcagaccaaagtcgatagctgtacccggcccctggctggtcagcaattttacccgtgcatcccagacgacgcgcttgtccagccattgttcggcgggaattttgtctttcagcgtcgggaagccggtcatattaccaatcgggaagatatcgtgcggcaccagcacggtggctggcgcggcgcaaatagccgcgacgatacgcccggaacggtggaactgtttaacggtttcaaccagcagagtgctatcgcgaaaacactccgcgcctttaatgccaccaggcagcacgatcacgtcatattcgccatcagccacttcgaccagcggcgcatccgccagcagcttcacgccgcgcgagcaggtaatcgccaggttaccatcgctggcgacgctggcagtggtgactttgataccgccgcgaaccagcagatcgatagtggtgacggcttcagtctcttcactaccaggggcgaggcaaaccagtgccgatgcgctcatattcactctcctttctttttaccatttcaaacaggcgggtgttttccggtacggcaatcccatgcgcgcgggcgcggcgtaagagaaaaccattgatatagtcgatttcagtgtggcgcagcgcgcggatatcctgcaacatcgacgagatattttccgctgtggcatcaatcacctgcatcacgtaatcacgcaaatcttctgctgaagtatgatgcccttcgcgttcgatcaccgccgcgacttcttcgcatatctgcataatttcttgcggatgatgacgtaattcaccgttcgggcaattccagatggcagtcagtggattaatcacgcagttgactgccagcttgcgccacagctcggcgcgaatattgttatgccaggcaacgtcaggcaacacggtttgcaaaatatccgccagataactgtaatccccgtcctgttgccgtgccgggccaatatgcgtgataccgtttgccacatgaataatgacattgccgtcgcggcgggctgcatgggtggtggtgcccatcagtaatggctgctgaatgttttgcaactcttcgatggtgcccatgccgttgtgaattaacagtattggcgtagttacaggcagtgtggacgcgaggcttttgacggcatcggaaacctgccatgctttcagcgtcaccaggagcagatcgctggtggcgagaaaatcgggatcgttggcggtcagcgattcgttaaatatcgaaccatctgtctcaaccagattcacgctacaataaggttgcggtacgcgcagccagccctgaacttcatgaccctgtttgcaaagtgctgtaagccataattgccctaaggcaccgcatcccaatacggtaattttcattgttcctcctcacccgcaaccactccgggtgttcaataaggctatcccttaattgtgcatgctgttgcgactatgcacaattaagggatacgtcctggtgcaggactgtcggttatttaactttgcgggtattatgcttcgcatcaaaaatgaagggagaggaaaagatgccatctttcgatattgtctctgaagttgatcttcaggaagcacgtaacgcggtcgataacgcgagccgcgaagtggagtcccgttttgacttccgtaacgttgaagcctcatttgagctgaacgacgccagcaaaaccatcaaagtgttgagcgagtccgatttccaggtcaatcagttgctggatattctgcgtgccaagctgctgaagcgcggcattgaaggcagttcgctggatgtaccggagaatatcgttcatagcggtaaaacctggtttgtggaagcgaaactgaaacagggcattgagagcgcgacccagaagaaaatcgtcaagatgatcaaagacagcaaactgaaagtgcaggcgcaaattcagggcgatgaaatccgcgtaacgggcaaatctcgtgatgatttgcaggctgtcatggcgatggtacgtggtggcgatctcggtcagccgttccagttcaaaaacttccgcgattaatcgcgactatgtgcgttttgttcatgtcagatgcggcatgaacgcctgattcggcctacaaaggtttgtaattcagaaactttgtaggcctgataagcgtagcgcagcaggcaattcgccgcgttttttatgcctgacgaattgcctgttctatctcaaagcgattcgtcactttgctgtcgattttcacataagctgaatgttcttcttctgcaatcaacacttctttgatgccttcagtttctagcaaacgcacttttaacgcctcgtttgcggcaatgttcgccgggatttcaatgcgcaaactgctgacatacggcggttctttcatggtactggcgactgtcagccacactgcggccagcattgcgccagcgagaaataccccctgaccgtcaaacatgccgttaatccagccgcccagcgaaccgccaatcgccacgccaagaaactggctggtggagtaaacacccatcgccgtacctttgtaacctgctggcgactctttactgataagtgagggcaggagggcttccatcaaattaaacgccacaaagaaaagctgcacgccgaccaccagttgccagaactgcgtttgcgcgttccacaacacaatttccgcaaccacgatcaacccgacgcagaagacaaagacttgcttcattttgcgcttaacttcagcgtagataatgaaaggcacgaccgagccaaaggcgattagcattgtcgccagatagaccttccagtgttcagccgccgggaaccctgcatcagccagttgtccgggcagggcaacaaacgtcgacatcagcaaaatatgcagacacataatgccaaagttgagtttcagcagccgcggttccgccagcactttactgaaactgcctttcaccattccggactcacgattaagtacgtgagtgctactgttgggcacaacccaaatggtcaacgcaatgccggtcgttgccagaatagcgatcatccagaacagcgcgtgcagcccaagtttgtgagtgatgatcgggccaagcaccatcgcaatggcaaaggtaatgccaaagctcacgccgataaacgccatcgctttggtgcggttttgttcgcgcgtgagatcggaaagcagcgccataacggcggcggcaattgctccagagccttgtagcgcccggcccagaataattccccagatggagtcggaaagcgcagcgataacgctaccggcggcaaacaccgccagcccaccgacaattaatggtttgcgaccaatgcggtcggaaagcaggccaaacggaatctgaaaaacggcctgagtcagaccataaataccaatggcaataccgattaatgcttcgctggcaccttgcagagccatgccgtacgtggtcagaaccggcagaaccataaacatgcccagcatgcgcaacgagaatacggtccctaaaccccaggtcgcgcgcctctcacctggcgtcattttataatcgttcattaccacctctgttttaaattcgcgactagtgtaaagcggcaaacgaatggggtaaacatgcggattttttagtaaatatttcgagagggatatgtttctaatgctaagaaaaaaggtgccgtagcacctttttaatagagaggttttgttaccacacagcagccagcagcgtatgcgagtccggtaccataaaatcaacggacatcatcaccgagagggcagtgatggcgatgatagagaagccgaacagcttgcgcgcccagattctgtcatcagcaactttataaccgcgcagagccatacctaaccaccagacgctaaccgccgcggcgaccaccagatatttatacccagcgtaaccgccaagagagagcatcagcgtggcaacggcaaaggcgatgatatacagcgtgatgtgattcttcgccaccgaaatgccttttaccactggcaataccggaatgtttgccgcctggtaatccttaaagcggaaaatggcgatggcataggagtgaggcatctgccacaggctgaagatagccagcaggatcgctgcgccgctatcgaactcaccggttaccgcacagtagccgatcaccggcggcgcagcgccggagagcgaaccaatcaacgtgccgtagacagagtggcgtttcatgtacaggctataaacgccgacataaaccacaaagcccatcacccccagccagcaggccagcggattcgcgccaaaccacagcagcataaagccagcaatacccagcaacgtggcgtacaccagcgagacagcaggagagatcaggcctttcaccagcacccgattcttcgtcctttccatctttctgtcgatatccctgtcgatgtagttgttaaacacacaacccgacgccacaaccagtgacaccccaaccagcgtgtagataaacaggggataatcaatgctgccctttgaggccagcaggaatcccccaatcaccgagatcaggttgccaaagatgatgcctggtttcgttacttgcaggtattgcttaaacatcataaccgccgctcttagtgcatcatcatgttgtagttgaggttccacataatccagatggagcctacaaccaggatagcgatgattagcacggtgaagacaaacgccgtcatgttccagccttcatctgatttggtattcatgtgcaggaagcacaccagatgcaccagaacctgtaccactgccattgccaggattgttcccagaattacggccggagaggcagctcctgtcatcaccatccagaacggaatcaccgtcagaatgatcgacaggataaagcctgtcatgtaggtttttacgctgccatgggacgcgccgctgtgatcggtagaatgactcattacatcgcccccatcagataaacaacagtgaacacacagatccaaaccacatccaggaagtgccagaacaggctcaggcacatgatgcgggtacggttagtgctggtcaggccgcgacgggcgatttgcaccatcagcaccgccatccagataagaccagaagtgacgtgcagaccgtgcgtgccgaccagcgcaaagaacgctgacaggaagccgctgcgatccggacccatgccgttaacaatcaggtgatggaattcatagatttccatcccgataaatccggcaccaaacaaccaggtcaacgccagccaggagataacctggcttttgttgtttttgtacatggcgatagccgccatgccgtaggtgatggagctgaacaacagcaagaaagtttcaaccagaacgaacggcagttcgaaaatgtccttacctgtcgggccgcctgcggtgccgttcaccagaacggcataggtagcaaacaagatagagaacagaatgcagtcgctcatcaggtagatccaaaatccgaagattttggttccgcctgcatcgtggtgcccgtgttcgtgcgcgtgggcagtcgcgtgcgtcaaagtatcagttgccatttttcagccctgccttagtaatctcatcgaaatgctggttttccagtttttcgatttctgccaccggcacgtagtaatccacgtcctcgtcgaagcttttcacgatccaggtgatgatcatgcctgcgaagccaacaatcgccagccaccagatatgccagatcatggcgaaaccgaagatggtggagaaagctgcaatgacgatacctgcaccgctgtttttcggcatatgaatttcttcatagtggtcaggctttttatacgcttcgcctttctctttcatttcccagaatgcatcacgttcgtgaacgtgcggcactacggcaaagttatagaacggaggcggggaagaggttgcccactccagcgtacggccaccccacgggtcgccagtcaggtcacggttctggtcgcggtcgcgaatagaaacgtacatctgaataacgaggcagagaatacccagcgcaatcagtactgcaccgctggctgcaatcatcagcatggtgtggaactgcgggtcaatctgctggctcaaacgacgggtcatgcccatgaagcccagcgcatacagtggcataaaggcaacgaagaagccgatgatccagaaccagaacgcgcgtttaccccaggtttcgttcagtttgaaaccgaacgctttaggccaccagtaggtcatccctgcgaagcagccgaagaccacgccgccgatgatcacgttatggaagtgcgcaatcaggaacaggctgttatgcagaacgaagtccgcgcccggtacggccagcagcacgccagtcatcccgcccaccgagaaggtgacgataaaaccgatggtccacagcatcgcagaatggaacacgatgcggccctgatacatggtgaacagccagttgaagatcttcaccccggtcgggatggcgataatcattgtggtgataccaaagaaggcgtttacgttcgcgcccgcacccatcgtaaagaagtggtgcagccaaacgatgaacgacagcacggtgatacagacggttgcccataccagcgaggtataaccaaacagacgtttacgcgagaaggttgccgcaatttcggagaacacaccgaaaacaggcaggatcaggatgtaaacttccgggtggccccaggcccaaatcaggttgatgtacatcatcatgttgccacccatatcgttggtaaagaaatgggtgcccagatagcgatccagggtcaacaacgcgacggtaaccgtcagaattgggaaggaagcaataatcagtacgttcgcgcacagtgatgcccaggtaaatactggcatcttgaacatggtcatgcccggtgcgcgcatcttcagaatggtaacgaagaagttgataccggtaagcgtcgtacctataccggatagctggagactccatatccagtaatcgacaccgactcccggactgtactctattcccgatagcggtggataggccagccagccggtctgcgcaaattcgcccacgccgagagaaacgttaaccagaatcacaccaacaacggtaaaccagaagcttaagttgttgaggaacgggaacgcaacgtcacgcgcgccgatctgcagcggaaccaccaggttcatcagaccgataacgaaaggcatcgccacgaagaagatcataatcacgccgtgcgcggtaaagatctgatcgtagtggtgaggtggcaggaagcccgcttcgcccgccgaggcaagagcctgctggctacgcatcataatggcgtcagcaaaaccacgcagcaacatcacaatcgccacgatgatatacatgataccgaggcgtttatggtcgacggaggtcagccactctttccacaggtaggtccacttaccgaagtaagtgatcaggccaacgagcgccagacctcccaaaataatgccagcgatcgtaaccatgacgataggttcatggaacgggactgcatcaagtgataattttccgaacatctttattcttcctcaacccctttaatgggcggattccgcgtggctcatgtccatgccttccataccttcgtgtgcgctgtgctcaccttctggctgggtcatgtccatgctcttaccgtgagccataaacttgttaattacatcggcaaacaagtctggtttcacgttggagaaatattccacctggttgtattcgctaggcgcggccagtttttcgaacgcagccatgtcagacatggtgttcggcgactgcttcgcttttgcgacccactggtcgaatgcggcgcgatccggtgttgcaatagctttgaacttcatgcctgagaagcccgggccgctgtagctggcggagataccgtcataagtgccgggttcgttggcgatcagatgcaggcgagtctgcataccggccatggcataaatctggctacccagacgcggaatgaagaaggagttcatcacggagttggaggtcactttgaagtacaccggagtgttcgccgggaaagcgatttcattcacggtagcaatgccctgttccgggtagatgaagaaccatttccagtccatggaaaccacttcgatggtaatgggcttctcgtcgtgtgccagcggcttgctaggctcaagagcgtgagtggttttccaggtcagtactgcaaggaagatgatgattaagataggtaccgtccagaccacagcttccactttattggagtgtgaccagttcgggctgtacttagcatctttattgctcgcacggtacttccaggcgaaaccaacagccatcaagattgcgggaataacgacaatcaacatcaggccaaatgccgtcagtatcagtgaacgttgctccagaccaatctgtcctttgggatctaacagcgcagaattacagccactgagcaatacagtgcctgcaaataatgacaaccatcccaaacttttattgtatttcctgagtctcatttaacgacctcaattccacgggatctggtggcgtttaaagtgtgtgggcattttacgggaaggttacattactgtaaacatgattaaattcctgttacttggatttggctgccaggtcacatatgttgcaaaacatatcaggttgattttaagaagctgttgcaaaagggcgttataacaaaaggggagtgctgaaggagtctgggcgggcaattggtataaccaatgtgaaataaaacaattatttaacaaataattatcattagagtgacaactgggtgatgagaaaataaagactcattagctgaatcgtgtaagaaaaatagaatttataaatggcgccaataatttccaaacgctaagccgcacaaaagaacaaatattaataagcgatactgatgtttatttagccgtaataattacggcgagtgattactacagctaaataatatttacagattacgtcagatgcgtttttcgtagcgccagataatccagcaaaccaccaagcacgacgccagaaagggcgactaaaaccccgacttccagcagagcaggcaggaaagagaagtgcgtcaaatccagcgcgtccatcgtcaatagcagtaaccacacggccaacaggctgacgcccgccgccagtgtccacatggcaaaggcataacctgccggatatgcggtacgggagataaagttgtcatttactcgtgtatattcaagcgtctggcggcaaaccagcagcaaaataagccctggtacggcagcggcgacggagaatagatagaatgtcgaccagccgtgtgcttcaacaaaccaacccgccacggggccgacataaactcgccctacagcagaaagcgctgagagcagggcaaattgagtagcggaaaatgacttattacatagcgtcattaacagcgcgacaaaggctgatgtgcccatcccgccacagaggttttcgaaaaagacggctgcgcccatgctgtagagatgcttatcagtaatcgacagcagccagtaaccggcgttagacgcaccttgtaaaatgccgaaaatcagcagtgcccggaacagtgacaggcgctgcatcaaaatcccaccgtacaatgcgccaacaatggtcgctagtaagccaagcgttttgttaaccacgcctacttcacccgcatcaaacccgacgccgcgaatcaaaaacgtggttgtcaggctcatggcgaatgcgtcgcccagcttatacagcacgataagaagcaaaataagccaggcattattgcgaccaaagaaatctcgcagaggtgcaacaaccgcttgttccagcgttttgggcacaggaatggtgtcggttggttctggtgcaagcaacgtcgcgataatacaggggatcaacagtgccgccattaaccagtacatgccctgccagcccagccatttatctgccagccacagggctaggccgccggaaaccagcatccctaaacggtaacccagcacgctgattgccgcgcccgcaccacgttcttctgccggaagcacatcggttttccacgcatcgaagactatatcctgggaagcagagcaaaaagcgatcaccactgccagcgccgccatccagcggagttgggtgcctggttcgagaaaacccatcgccgcaatggcgactaataacaggatttgcgtggcgagcagccaaccgcgccgccgcccaaaaaatggaggcgtgtagcggtccatcagcggtgaccagaggaatttaaaaacgtaagcctggcctaccagagagaagaaaccaatggttttgagatcgatattctcgaccgtcatccaggcctgtaaggtaccggatgtcagggcgagcggtagcccggaagcaaaacccaggatcagcaatatggctgaacgcggctgttgaaaaatacgtaaatattgactggacatgggcgtctacaggcccggcttgcaccgggccagagggcagaaattaacgcgcgttctgcttgatgaattcgtggatgctggtgtcctgagacatatcagcgatggtatcggtcagcacactgttaaccgcatcggcgatatttttgttggaggcctggaacgcaccttcaacgttgtagctggcacgatagtttttggtcattttgttgccattctgcgcggtagcgatgatggcgatatccgctttggtcgcgatgttgtagcgcacgttgccctgggacacgtcagcatacagttggctaacgatgatttgcagattaaccgggccattcggaccaaccatgtaaccacgcgcggtcatctgtttttccagcacttcttgcagcaggaaacgcagatcgcgggaggcggtcagggtaacgatttgattatcgcgggtgacttttgccagcgcctgatcggtacgctgatcggcaccattaatgcttacggtgacgcccatcaggcttggatcctgctgtggcagtgtaatcgtcggggaaacttcaatagttgttggcggttttgcgcatcctgcaagcataaacagagcaactaacgggaagaggatttttttgaacatgttcgggctctcagagactcttaagcgtgtttggtaaaaattcccgccatcataacattgccaacggcgaggggaagtgggtaaggcatgtaaattcatcatgttgacgaaataatcgcccctggtaaaagaaacactgatgcgaggcctgtgtttcaatctttaaatcagtaaacttcatacgcttgacggaaaaaccaggacgaaacctaaatatttgttgttaagctgcaatggaaacggtaaaagcggctagtatttaaagggatggatgacatctcagcgttgtcggaggagatatttcatgatgatacgtgagcggatagaagaaaaattaagggcggcgttccaacccgtattcctcgaagtagtggatgaaagctatcgtcacaatgtcccagccggctctgaaagccattttaaagttgtgctggtcagcgatcgttttacgggtgaacgttttctgaatcgtcatcgaatgatttacagtactttagcggaggaactctctactaccgttcatgcgctggctctgcatacttacactattaaggagtgggaagggttgcaggacaccgtctttgcctctcctccctgtcgtggagcaggaagcatcgcgtaaaaacgcatttgcaactgtcggcgcttttccagtatgttgctaaagattttatgaaaaacggcctgcgggccgttttgttttgtctggattttgcgctttttgcccagcattcagacgaaaattgcccgggaattgtgaaaaaatacgcgacagcgcgcaataaccgttctcgactcataaaagtgatgccgctataatgccgcgtcctatttgaatgctttcgggatgattctggtaacagggaatgtgattgattataagaacatcccggttccgcgaagccaacaacctgtgcttgcggggtaagagttgaccgagcactgtgattttttgaggtaacaagatgcaagtttcagttgaaaccactcaaggccttggccgccgtgtaacgattactatcgctgctgacagcatcgagaccgctgttaaaagcgagctggtcaacgttgcgaaaaaagtacgtattgacggcttccgcaaaggcaaagtgccaatgaatatcgttgctcagcgttatggcgcgtctgtacgccaggacgttctgggtgacctgatgagccgtaacttcattgacgccatcattaaagaaaaaatcaatccggctggcgcaccgacttatgttccgggcgaatacaagctgggtgaagacttcacttactctgtagagtttgaagtttatccggaagttgaactgcagggtctggaagcgatcgaagttgaaaaaccgatcgttgaagtgaccgacgctgacgttgacggcatgctggatactctgcgtaaacagcaggcgacctggaaagaaaaagacggcgctgttgaagcagaagaccgcgtaaccatcgacttcaccggttctgtagacggcgaagagttcgaaggcggtaaagcgtctgatttcgtactggcgatgggccagggtcgtatgatcccgggctttgaagacggtatcaaaggccacaaagctggcgaagagttcaccatcgacgtgaccttcccggaagaataccacgcagaaaacctgaaaggtaaagcagcgaaattcgctatcaacctgaagaaagttgaagagcgtgaactgccggaactgactgcagaattcatcaaacgtttcggcgttgaagatggttccgtagaaggtctgcgcgctgaagtgcgtaaaaacatggagcgcgagctgaagagcgccatccgtaaccgcgttaagtctcaggcgatcgaaggtctggtaaaagctaacgacatcgacgtaccggctgcgctgatcgacagcgaaatcgacgttctgcgtcgccaggctgcacagcgtttcggtggcaacgaaaaacaagctctggaactgccgcgcgaactgttcgaagaacaggctaaacgccgcgtagttgttggcctgctgctgggcgaagttatccgcaccaacgagctgaaagctgacgaagagcgcgtgaaaggcctgatcgaagagatggcttctgcgtacgaagatccgaaagaagttatcgagttctacagcaaaaacaaagaactgatggacaacatgcgcaatgttgctctggaagaacaggctgttgaagctgtactggcgaaagcgaaagtgactgaaaaagaaaccactttcaacgagctgatgaaccagcaggcgtaatttacgcagcataacgcgctaaattcgcacaaaggcccgtcaccgccaggtggtgggcttttttttgtcatgaattttgcatggaaccgtgcgaaaagcctctttcggtgttagcgtaacaacaaaagattgttatgcttgaaatatggtgatgccgtacccataacacagggactagctgataatccgtccataaggttacaatcggtacagcaggttttttcaattttatccaggagacggaaatgtcatacagcggcgaacgagataactttgcaccccatatggcgctggtgccgatggtcattgaacagacctcacgcggtgagcgctcttttgatatctattctcgtctacttaaggaacgcgtcatttttctgactggccaggttgaagaccacatggctaacctgattgtggcgcagatgctgttcctggaagcggaaaacccagaaaaagatatctatctgtacattaactccccaggcggggtgatcactgccgggatgtctatctatgacaccatgcagtttatcaagcctgatgtcagcaccatctgtatgggccaggcggcctcgatgggcgctttcttgctgaccgcaggggcaaaaggtaaacgtttttgcctgccgaattcgcgcgtgatgattcaccaaccgttgggcggctaccagggccaggcgaccgatatcgaaattcatgcccgtgaaattctgaaagttaaagggcgcatgaatgaacttatggcgcttcatacgggtcaatcattagaacagattgaacgtgataccgagcgcgatcgcttcctttccgcccctgaagcggtggaatacggtctggtcgattcgattctgacccatcgtaattgatgccagaggcgcaactgtgccgctatacttatccagggcggcacaacgctgtaagcggcttgcgcctgagaatggcatttgcgtcgtcgtgtgcggcacaaagaacaaagaagaggttttgacccatgacagataaacgcaaagatggctcaggcaaattgctgtattgctctttttgcggcaaaagccagcatgaagtgcgcaagctgattgccggtccatccgtgtatatctgcgacgaatgtgttgatttatgtaacgacatcattcgcgaagagattaaagaagttgcaccgcatcgtgaacgcagtgcgctaccgacgccgcatgaaattcgcaaccacctggacgattacgttatcggccaggaacaggcgaaaaaagtgctggcggtcgcggtatacaaccattacaaacgtctgcgcaacggcgataccagcaatggcgtcgagttgggcaaaagtaacattctgctgatcggtccgaccggttccggtaaaacgctgctggctgaaacgctggcgcgcctgctggatgttccgttcaccatggccgacgcgactacactgaccgaagccggttatgtgggtgaagacgttgaaaacatcattcagaagctgttgcagaaatgcgactacgatgtccagaaagcacagcgtggtattgtctacatcgatgaaatcgacaagatttctcgtaagtcagacaacccgtccattacccgagacgtttccggtgaaggcgtacagcaggcactgttgaaactgatcgaaggtacggtagctgctgttccaccgcaaggtgggcgtaaacatccgcagcaggaattcttgcaggttgatacctctaagatcctgtttatttgtggcggtgcgtttgccggtctggataaagtgatttcccaccgtgtagaaaccggctccggcattggttttggcgcgacggtaaaagcgaagtccgacaaagcaagcgaaggcgagctgctggcgcaggttgaaccggaagatctgatcaagtttggtcttatccctgagtttattggtcgtctgccggttgtcgcaacgttgaatgaactgagcgaagaagctctgattcagatcctcaaagagccgaaaaacgccctgaccaagcagtatcaggcgctgtttaatctggaaggcgtggatctggaattccgtgacgaggcgctggatgctatcgctaagaaagcgatggcgcgtaaaaccggtgcccgtggcctgcgttccatcgtagaagccgcactgctcgataccatgtacgatctgccgtccatggaagacgtcgaaaaagtggttatcgacgagtcggtaattgatggtcaaagcaaaccgttgctgatttatggcaagccggaagcgcaacaggcatctggtgaataattaaccattcccatacaattagttaaccaaaaaggggggattttatctcccctttaatttttcctctattctcggcgttgaatgtgggggaaacatccccatatactgacgtacatgttaatagatggcgtgaagcacagtcgtgtcatctgattacctggcggaaattaaactaagagagagctctatgaatcctgagcgttctgaacgcattgaaatccccgtattgccgctgcgcgatgtggtggtttatccgcacatggtcatccccttatttgtcgggcgggaaaaatctatccgttgtctggaagcggcgatggaccatgataaaaaaattatgctggtcgcgcagaaagaagcttcaacggatgagccgggtgtaaacgatcttttcaccgtcgggaccgtggcctctatattgcagatgctgaaactgcctgacggcaccgtcaaagtgctggtcgaggggttacagcgcgcgcgtatttctgcgctctctgacaatggcgaacacttttctgcgaaggcggagtatctggagtcgccgaccattgatgagcgggaacaggaagtgctggtgcgtactgcaatcagccagttcgaaggctacatcaagctgaacaaaaaaatcccaccagaagtgctgacgtcgctgaatagcatcgacgatccggcgcgtctggcggataccattgctgcacatatgccgctgaaactggctgacaaacagtctgttctggagatgtccgacgttaacgaacgtctggaatatctgatggcaatgatggaatcggaaatcgatctgctgcaggttgagaaacgcattcgcaaccgcgttaaaaagcagatggagaaatcccagcgtgagtactatctgaacgagcaaatgaaagctattcagaaagaactcggtgaaatggacgacgcgccggacgaaaacgaagccctgaagcgcaaaatcgacgcggcgaagatgccgaaagaggcaaaagagaaagcggaagcagagttgcagaagctgaaaatgatgtctccgatgtcggcagaagcgaccgtagtgcgtggttatatcgactggatggtacaggtgccgtggaatgcgcgtagcaaggtcaaaaaagacctgcgtcaggcgcaggaaatccttgataccgaccattatggtctggagcgcgtgaaagatcgaatccttgagtatcttgcggttcaaagccgtgtcaacaaaatcaagggaccgatcctctgcctggtagggccgccgggggtaggtaaaacctctcttggtcagtccattgccaaagccaccgggcgtaaatatgtccgtatggcgctgggcggcgtgcgtgatgaagcggaaatccgtggtcaccgccgtacttacatcggttctatgccgggtaaactgatccagaaaatggcgaaagtgggcgtgaaaaacccgctgttcctgctcgatgagatcgacaaaatgtcttctgacatgcgtggcgatccggcctctgcactgcttgaagtgctggatccagagcagaacgtagcgttcagcgaccactacctggaagtggattacgatctcagcgacgtgatgtttgtcgcgacgtcgaactccatgaacattccggcaccgctgctggatcgtatggaagtgattcgcctctccggttataccgaagatgaaaaactgaacatcgccaaacgtcacctgctgccgaagcagattgaacgtaatgcactgaaaaaaggtgagctgaccgtcgacgatagcgccattatcggcattattcgttactacacccgtgaggcgggcgtgcgtggtctggagcgtgaaatctccaaactgtgtcgcaaagcggttaagcagttactgctcgataagtcattaaaacatatcgaaattaacggcgataacctgcatgactatctcggtgttcagcgtttcgactatggtcgcgcggataacgaaaaccgtgtcggtcaggtaaccggtctggcgtggacggaagtgggcggtgacttgctgaccattgaaaccgcatgtgttccgggtaaaggcaaactgacctataccggttcgctcggcgaagtgatgcaggagtccattcaggcggcgttaacggtggttcgtgcgcgtgcggaaaaactggggatcaaccctgatttttacgaaaaacgtgacatccacgtccacgtaccggaaggtgcgacgccgaaagatggtccgagtgccggtattgctatgtgcaccgcgctggtttcttgcctgaccggtaacccggttcgtgccgatgtggcaatgaccggtgagatcactctgcgtggtcaggtactgccgatcggtggtttgaaagaaaaactcctggcagcgcatcgcggcgggattaaaacagtgctaattccgttcgaaaataaacgcgatctggaagagattcctgacaacgtaattgccgatctggacattcatcctgtgaagcgcattgaggaagttctgactctggcgctgcaaaatgaaccgtctggtatgcaggttgtgactgcaaaatagtgacctcgcgcaaaatgcactaataaaaacagggctggcaggctaattcgggcttgccagcctttttttgtctcgctaagttagatggcggatcgggcttgcccttattaaggggtgttgtaaggggatggctggcctgatataactgctgcgcgttcgtaccttgaaggattcaagtgcgatataaattataaagaggaagagaagagtgaataaatctcaattgatcgacaagattgctgcaggggctgatatctctaaagctgcggctggccgtgcgttagatgctattattgcttccgtaactgaatctctgaaagaaggggatgatgtagcactggtaggttttggtacttttgccgttaaagagcgtgctgcccgtactggccgcaacccgcagaccggtaaagagatcaccatcgctgctgctaaagtaccgagcttccgtgcaggtaaagcactgaaagacgcggtaaactaagcgttgtccccagtggggatgtgacgaagttcaagggcgcatctactgatgtgccttttttatttgtattcggtgactttctgcgtcttgtgggctgacaattgcccccgtttcttgtcacaataggcctttgcgcgcatcgatacgttgcgtgaggtacacagtcatctacagcggagtgttgttacaccatgatggacagcttacgcacggctgcaaacagtctcgtgctcaagattattttcggtatcattatcgtgtcgttcatattgaccggcgtgagtggttacctgattggcggaggcaataactacgccgcaaaagtgaatgaccaggaaatcagccgtgggcaattcgagaacgccttcaacagcgagcgtaatcgcatgcagcaacagctgggcgatcaatactccgagctggcagcgaacgaaggctatatgaaaaccctgcgtcaacaggtgctgaatcgtctgatcgacgaggcgctgctggatcagtacgcacgtgagctgaaactgggtatcagcgatgagcaggttaaacaggcgattttcgcgaccccagccttccaggttgacggcaaatttgataacagccgctataacggtatcctcaaccagatggggatgaccgccgatcagtacgcccaggcgctgcgtaaccagctcactacccaacagctgattaacggcgttgccggtaccgattttatgctgaaaggtgaaaccgacgagctggcggcactggtcgcgcaacaacgcgtggtgcgtgaggcgactatcgatgttaacgcgctggcggcgaagcagcctgtgaccgaacaggagattgccagctactacgaacaaaacaaaaacaatttcatgacgccggaacaattccgcgtgagttacatcaagctggatgccgcaacgatgcagcaaccggttagcgatgcggatatccagagctactacgaccagcatcaggatcaattcacccagccgcagcgtacccgctacagcatcatccagaccaaaactgaagatgaagcgaaagcggtacttgatgagctgaataaaggcggtgattttgctgcattagccaaagaaaaatctgccgatattatctctgctcgtaacggcggcgatatgggttggttagaagatgccactatcccggacgaactgaaaaatgctggtctgaaagaaaaaggccaactgtctggtgtcatcaaatcttcggtcggtttcctgattgtacgtctggacgacattcagccagcgaaagtgaaatcgttagacgaagtacgtgacgacattgcggcgaaagtgaaacacgaaaaagccctcgatgcgtactacgcgctgcagcagaaagtgagcgatgcggcaagcaacgacaccgagtctctggccggtgcagagcaagctgccggcgttaaagccactcagacgggttggttcagcaaagataacctgccggaagagttgaacttcaagccggttgccgacgctatctttaacggcggtctggtaggtgaaaacggcgcgccgggcatcaactctgacatcatcaccgtagacggcgaccgcgcattcgtgctgcgcatcagcgagcacaaaccggaagcggtgaaaccgttggcagatgttcaggaacaagttaaggcattggttcagcacaacaaagctgaacaacaggcgaaagtggatgctgagaaactgctggttgatttgaaagccggcaaaggtgcggaagctatgcaggctgccggtctgaaatttggcgagccgaaaaccttaagccgttccggtcgtgacccgattagccaggcggcgtttgcactgccactgccagcgaaagacaaaccgagctacggtatggcgaccgatatgcaaggtaatgtggttctgctggcgctggatgaagtgaaacaaggttcaatgccggaagatcagaaaaaagcgatggtgcagggtatcacccagaacaacgcacaaatcgtctttgaagctctgatgagtaacctgcgtaaagaggcgaaaatcaaaattggcgatgcgctggaacagcaataatcctgaagccgcctcgcaaaaaaatgcgttgcagctgtaacaagaaaaggtcgctttcgcggccttttccatttctgaacattgccatttgtttactgttttcactgccgttaaggtgattccactgttaacaaacaaggagaaaacagtatgaaacacggaattaaagcactgctcattaccctgtccctggcctgtgccggaatgtctcatagcgcgctggcggcagcttctgtggcgaaaccgacggcggtagaaaccaaagcggaagctcctgcagcacaaagtaaagcagcagtaccggcgaaagccagtgacgaagaaggcacccgggtcagcattaataatgccagcgcggaagagctagcccgcgcgatgaatggcgttggcctgaagaaagcgcaggcgattgtcagttatcgcgaagagtacggtccgtttaaaactgtggaggatctaaagcaggtgccggggatgggcaattcgctggtggaacgtaatctggcggtattaaccctgtaattaatttgcatagtggcaattttttgccagactgaagaggtcataccagttatgacctctgtacttataacaacaacgtaaggttattgcgctatgcaaacacaaatcaaagttcgtggatatcatctcgacgtttaccagcacgtcaacaacgcccgctaccttgaatttctcgaagaagcccgctgggatgggttggaaaatagcgacagttttcagtggatgacggcccataacatcgccttcgtcgtggtcaatatcaatattaactatcgtcgcccagcggtattaagtgacctgttaactattaccagtcagttgcagcaattaaacggtaaaagcggcatcttaagccaggtcattacactggagccggaagggcaggtggtagcggatgcgcttattacgtttgtttgtattgatcttaaaacgcagaaagcattagctctggaaggggaattgcgcgaaaagctggagcagatggttaagtaaacgttttgtggtgccggatgctcaagccgcatccggcgacacccggaataattacctcaacccggttttctgcttcatcgctgccatcaccgtcggtttatcggccagataatgattcaaaccgttggcgcgtaaattacatgccgcacaatgaccgcaaccgtcgcctttaaagccgttatagcaggtcaacgtttcgttacggactaaatccagtttgccgtaataatctgccagcgcccaggtttccgctttatcaatccacatcagcggcgtttcaaaacgaatatctttcgccatgcccaaactgacggcatggtttagtgctttcacaaactcatcgcggcaatccgggtagccggagaaatccgtttcgcagacgccagtaattacggcttctgcttttacctgatacgcatatattgccgccagcgtcaggaacaaaatattacgccctgggacaaacgtattcgggataccatcggcttcaggttcataatcaggcaccggaatgctgtcacgcgtcaggctactgaccgccagctcgttgagcagggtgacatccagcaccttatgcgcgcgtgcccccagtttcagcgccagttcgcgtgccacgtcgatttctgcgcgatgccgctgaccgtaatcgaacgtcacgcaatggacttcatcatattgttgtaatgcctgcaccagacaggtggtggaatcctgacctccactgaacacaacgacagcacgtttcatagataatcctgcttgaacaataaaagcgttatggtaacgcctgcgattaacccggaccagctattcattgcgatggcgcgggaagccaggcttcggtaaattcaaaccagccgcgcggtgtcagtcgcacaccgttcacgccgggaggggcactaatgcgatagtgatagttgaacagcggcgtcagcgtcgcatctgtcattaactggctaaaaaccgctttcagggcattaaatcggttttcttcatcaggcattatttgcacggcatccagtgtcgattgtagatgtgcgtatgctggagcgtcgaaaacatgtggccacagcggatcgcagcgcagccattgctccagagtatattccggtgcttcgccaattaatctgtcgcccatcatgaggtctgcgtgtgcctgtagggtcgtgtcgtcccagttttttgcgttatgaaaaataattgtgagttcacagccttccgctgccagtgtcgcctgtaggcgttctgccatggtatgaagttctatcggtaggtgataaaccagcgtcaaggttttcggtagtttgacttcatccggtacctgccaatgcggaatagtccagcctggcagtaatgcatgactggcggtgatcaggttttctccgacttctaacgtttgtaataaaccggattgatgaataatggagatcacttttcgcgcctgccagagggagagtcggggacttttgcgcaacgtcaaatagcaaaaacctaaactgatgccgctactgacctggctgacccgttgcagctcctccggtttgccgatggtgatttgcacgggatgccgacaactggttcccaaatctttttcgaaaagcggcggagttatccagtactcaaccgctttaagcagcggatgacgtaaatggtaataatcatggctttccaggcgcaccagctctgctgtgaattgtgttaagcgaaaaggacccgtgccgatcagtgggaattgcggatgcgccagatggctgcaatagctcgccagccggtgcgcaagccagtaatcagggcgatgtaaaaagaaggtcagacactgcggatgggtgacttcaatacgcttcacgctaataaataattgatccagtgctggcagttgtaacagcatcaataatcgctggtgtaagtgtgaggcttttactgcatcgccgttatgccagtgtagggttgaacgaagataaaagtcccagcgtaacccgtcagtagaggtttcccagtgatgcgctaaatcgccaatcgggcgctgagtattattatcgaagcgggtcaggccggaaaatatctgcccggcgagatgctgctcggcacggccgggcaaaaagcctggttgtagcggttcgagcgggcgatagtagggaatacgcaacgtgggtgtatcgttttgccattgtccgcccataaacggctgtaacagagtgcgcagctcacctggggccagttgcgccagctccagcacatcttgctgctttccggtttccagtgcctgttccatcatcgcattgcgtagcgattccggcgtgaccagaaagcgtaattgtccgcgctttccgcgtcctgactgcgcctgccactccagccatcccgcctcctgtgcctgacgcaacagcgtacgaacatggcgttcgctgcaaaaacagcgttcggccagttcgctgacggtgacggtttgcggctttccggcggaaggttgccacagacgttgatactggttaagacggttgagcaatcgcatataaacccggaacaatattatttaactattcactattacttccgtatatatcaggtgatactcaatcaccattaaccgtgtcacagagtggagaaagaaatggctcgtctggcagcatttgatatggatggcactttattgatgcccgaccatcatttaggtgagaaaaccctctctactttggcgcgactgcgtgaacgcgacattaccctcacttttgccacggggcgtcatgcgctggagatgcagcatattctcggggcgctatcgctggatgcgtatttgattaccggcaacggaacgcgcgtgcattctctggaaggtgaacttttacatcgtgatgatttacctgcggatgtcgcggagctggtgctgtatcagcaatgggatacccgagccagcatgcatatcttcaatgacgacggttggtttaccgggaaagagatccctgcgttgttgcaggcatttgtctatagcggttttcgttatcagataatcgatgtcaaaaaaatgccactcggcagcgtcaccaagatctgcttctgtggcgatcacgacgatcttacacgcttgcagatccagctatacgaagcattaggcgagcgtgcacatttgtgtttttccgccacggattgcctcgaagtgctgccggtgggctgcaataaaggcgctgcattgacggtgctgacccaacatttaggtttatcgttgcgcgattgcatggcctttggtgatgcgatgaacgatcgcgaaatgttagtcagcgtcggtagcggatttattatgggcaatgcgatgccgcaactgcgcgcggagctcccgcatttaccggtgattggacattgccgaaatcaggctgtctctcactatttgacgcactggctggactatccacatctaccttattcccccgaataacgagatcccttccagcaccgggcaattgcccggttttttttgcgttgaatttgtcattttgtgccgtggtgtttaaaccgcacagaataaattgtcgtgatttcacctttaaaataaaattaaaagagaaaaaaattctctgtggaagggctatgttagataaaattgaccgtaagctgctggccttactgcagcaggattgcaccctctctttgcaggcactggctgaagccgttaatctgacaaccaccccttgctggaagcgcctgaaacggctggaggacgacggtatccttatcggcaaagtcgccctgctggatccggaaaaaataggcctcggcctgaccgcttttgtgctgataaaaacgcaacatcacagcagcgaatggtattgccgctttgtcacggtggttaccgaaatgccagaagtgctggggttctggcgcatggctggtgaatacgattatctgatgcgcgtccaggttgccgacatgaaacgctacgacgagttttataagcgtctggtaaacagcgtgccggggctgtcggacgtcacttccagcttcgcgatggaacagattaaatacaccacttctttacccatcgaataaatatccagaatcaggtcaggacacaacgcgtgcgattatttgctcaattaagctggtatttccgtcgggaatggcgtcgctatctcggggctgtcgccttgcttgtcattatcgcgatgctgcaactggttccgccaaaagtggttggtattgttgtcgatggcgtgacagaacaacactttactaccgggcagatcctgatgtggatcgccaccatggtgctgattgccgttgtggtttatctcctgcgttacgtctggcgggtattgctgtttggtgcgtcttatcaactggctgttgaactgcgtgaagattattaccgtcagctaagccggcagcatcctgagttttacctgcgtcatcgcaccggtgacctcatggctcgtgcgaccaatgacgtcgatcgcgtcgtgtttgccgccggagaaggggtgctgacgctggtggattcactggtgatgggctgcgctgtgttgattatgatgtctacgcaaattagctggcagttgaccttattttccctgttgccgatgccagtgatggcgatcatgattaagcgcaacggcgatgctttgcatgaacgctttaagctggcacaggcggcgttttccagtcttaatgaccgcacccaggaaagcctcaccagtatccgcatgatcaaagcctttggtctggaagatcgccagtcggcgttatttgccgcggatgccgaagataccggcaaaaaaaacatgcgggtggcgcgtattgatgctcgtttcgacccgaccatctatatcgcgattggtatggcgaacttgctggcgattggcggcggtagttggatggtggtgcagggcagtttaacgctgggccagctcaccagttttatgatgtatttaggtctgatgatttggccaatgctggcgctggcatggatgtttaacattgtggaacgtggtagtgctgcgtacagccgtattcgcgcgatgctggcggaagcgccggtggtgaacgatggtagcgaacccgtgccggaagggcgtggcgaactggatgtaaatattcaccagttcacgtatccgcagactgaccatcctgcgctggaaaacgtcaatttcgccctgaaacccggtcagatgctgggtatctgcgggccgactggttccggcaaaagtaccctgttgtcgctcattcagcgtcatttcgacgtcagcgagggggatattcgctttcatgatattcctctgacgaagttacaactcgatagctggcgtagccgcctggcggtagttagccagacgccattccttttttctgacactgtggcgaataacatcgcgctgggttgcccgaatgccacccagcaagagattgagcatgtcgcgcggttagccagcgtacatgacgatattttgcgtctaccgcaaggttacgatacagaggtgggcgagcgcggtgtgatgctttccggcgggcaaaaacagcgtatctccattgctcgtgcgttattagtcaacgcggaaatcctcatccttgatgatgcgctttcggcggtggacggacgcactgagcaccagatcctgcataacctgcgtcagtgggggcagggaagaacggtaatcatcagtgcccatcgcctttctgcactgacggaagccagtgaaattattgtgatgcagcacggacatatcgcccagcgtggcaatcatgatgtgctggcacaacaaagcggctggtatcgcgatatgtatcgctatcaacaactggaggcggcgctcgacgacgctccggaaaatcgcgaggaggccgtcgatgcgtagttttagccaactgtggccgactctcaagcgcctgttagcgtacggttcgccgtggcgtaaaccgctggggattgcggtcctgatgatgtgggttgcggcggcggcagaagtcagtgggccgctgcttatcagctattttatcgacaatatggtagcgaaaaataacctgccgttgaaagtggttgcagggctggctgcggcgtatgttgggctgcaactgtttgccgccgggctacattacgcgcagtcgctgctgtttaatcgggcggcagtaggcgtagtgcaacagttgcgtaccgacgtgatggatgctgcgttacgccagccattaagcgagtttgatacccaacccgtcgggcaggtgatttcccgcgtcactaatgacactgaagtgatccgcgatctctacgttaccgtagtggcaactgtcctgcgcagtgccgcgctggtgggcgcgatgctggtggcgatgttcagcctcgactggcgaatggcactggtggcgataatgattttcccggtggtgctggtggtaatggtgatataccagcgttacagcacgccgattgtccgtcgtgtgcgcgcctatttggcggatatcaacgacggctttaacgaaatcatcaatggcatgagcgttatccagcagtttcgtcagcaggcgcgatttggcgaacgtatgggggaggccagtcgttcacactatatggcgaggatgcaaaccctgcgcctcgacggttttctgctgcgtccgctgctgagtctgttttcatcgctcattctttgtggcttgttgatgctgtttggcttctccgccagcggcaccattgaagtgggcgtgctgtatgcgtttatcagctatcttgggcgacttaacgaaccattaatcgaactgaccacgcaacaggcgatgctgcaacaggctgttgttgctggtgagcgcgtgtttgaactgatggacggaccgcgccagcaatatggcaatgatgatcgcccgttacagagtggcaccatcgaagtcgataacgtgtcatttgcttatcgcgatgacaatctggtgctaaagaacattaatctctctgtgccttcgcgcaattttgtggcgctggtcgggcataccggcagtggcaaaagcaccctcgccagtttattgatgggctattacccgctaacggaaggtgagattcgccttgatggtcgtccattaagttcgctaagtcacagcgcgctgcgccagggcgtggcaatggtgcagcaagatccggtggtgctggcggataccttcctcgccaacgtgacgctggggcgggatatctccgaagaacgcgtctggcaggcgctggaaaccgtgcaactggcggagctggcgcgtagcatgagcgacggtatttacacgccgctgggcgagcaggggaataatctctcagttgggcaaaagcaactgctggcactggcgcgcgtgctggtcgagacgccgcaaatcctgatccttgatgaggcaaccgccagcattgactccggtactgaacaggcgattcaacatgctctggcggcggtgcgtgaacataccacgctggtagtgattgctcaccgcttatcgaccattgttgatgccgacaccattctggtgcttcatcgtgggcaagccgtggagcagggcactcaccagcaactgctggcggcccagggacgctactggcagatgtatcaactgcaacttgcgggcgaagagctggcagccagcgtgcgtgaagaggaatcattgagcgcctgaatagcgcaatatttcatcgttggtgcaaaaatgtaacgcactgtgcactgtcatagtgcgttttcattttcaaacttcttaacttcctgctctctttctcgtttttcatttctggcacaccgcttgcaataccttcttcgtgtagcagaaccattaccgaattctgaccggaggggatctatgaagctggtgaccgtgataatcaaaccattcaagctggaagacgttcgtgaagcgttatcttccattggtattcagggcctgaccgtcaccgaagtgaaaggtttcgggcgtcagaaagggcatgccgagctgtaccggggggcggaatacagcgtcaatttcctgccaaaagtaaaaattgatgtggcgattgctgatgaccaactcgatgaagtgatcgatatcgtcagtaaggcggcttacaccggaaaaattggcgacggcaaaatcttcgtcgctgaattgcaacgcgtcattcgtattcgtaccggcgaagccgacgaagcggcgctgtaatctctggcacacagcaacaggaacgaaaaatgaagatagcgacgataaaaactgggcttgcttcactggcgatgcttccgggactggtaatggctgcacctgcggtggccgataaagccgacaatgcgtttatgatgatttgtactgcgctggtgctgtttatgactattccggggattgccctgttttacggtgggttgattcgcggcaaaaacgtgctgtcgatgctgacgcaggtgacggtgacatttgcactggtctgtattctctgggtggtttacggttactcgctggcgtttggtgagggcaacaacttcttcggcaacattaactggttgatgctgaaaaacatcgaactgacggcggtgatgggcagcatttatcagtatatccacgtggcgtttcagggatcgtttgcctgcattaccgtcggcttgatagttggggcgctggcggaacgaatccgcttctcagctgtgttgattttcgtggtggtatggctgacgctctcttacattccgattgcgcatatggtgtggggcggtggtttgctggcttctcacggtgcgctggatttcgcgggtggcaccgtggtgcacattaacgccgcaatcgccggtctggtgggcgcgtatctgataggaaaacgcgtgggcttcggtaaagaggcgtttaaaccgcacaacctgccgatggtcttcaccgggactgccattctctatatcggttggtttggctttaacgccgggtcagcgggcacggcgaatgaaatcgcggcactggcatttgtgaatactgtggtcgcaacggcggcggcaattcttggctggatcttcggtgaatgggcgctgcgtggtaagccttcactgctgggggcgtgttctggcgcgattgccggtctggtcggcgtgacgccagcctgcggctacattggggttggcggcgcgttgattatcggcgtggtagctggtctggcgggcttgtggggcgttaccatgctcaaacgcttgctgcgggtggatgatccctgcgatgtcttcggtgtgcacggcgtttgtggcattgtcggctgtatcatgaccgggatttttgccgccagctcgctgggcggcgtgggcttcgctgaaggtgtgacgatgggccatcagttgctggtacagctggaaagcatcgccattacgatcgtctggtccggtgttgtggcatttatcggctacaaattggcggatctgacggttggtctgcgtgtaccggaagagcaggagcgagaagggctggatgtcaacagccacggcgagaatgcctataacgcgtaacaagcactgcaaaaaacagccggacggttttcacctccggctatttttttaattgtgattacgcatcaccccttcctgaacggtcgaggcaaccagtacgccgtcttgggtataaaactcaccgcgcacaaagccacgtgcgctggacgccgaggtgctctccacgctatacagcagccattcattcaaattaaacgggcgatggaaccacatggaatggtcaatggtggcaatctgaatccccggttcgagaaaaccgatgccgtgcggctgtagagctaccggcaggaagttaagatcagaagcgtaaccgagcagatactgatgaacgcgcaggtcatccggcacgctaccatttgcgcggatccacacctgacgatgtggttctgcgacgtgacctttcagtgggttatgaaactccaccggacggacttccagcggacgatcgcagatgaatttatctttcagcactggcggcagcaggtgcgccagcgattgggcgatttgcgtttccgaagggaggccatcaggcgctggcgcggacggcattgttttttgatgttcgaaacccgcttctggtgcctggaaagaggcagtcatataaaaaatcggtttgccgttttgaatagcagcaacccggcgggcgctgaagctgttaccgtcacgcagcgtttcgacatcataaataatcggcttcttactatcgccagggcgaagaaagtagctgtgaaacgaatgtaccagccgctcttcagggacggtctcttttgcagcatacaaggcctgacccacgacctggccgccaaacacctggcgtaaacctaaatcttcactctggccgcgaaagagtccttcctcaattttttccagatttaacaatgtcagtaaattttttagcgcctgactcatataactctccagtaacaaagctgccgcagcaagccaaagtgagttgagtataacgcaaatttgctactggtccgatgggtgcaatggtctgaattacgggctaattacaggcagaaatgcgtgatgtgtgccacacttgttgacgttactattttgttaaccactcttccggcgaggaaagttagcccgctggtgcattgataataaggagaaatgaatgaaactcgtgcacatggccagtggtttagcggttgcgattgcgttggcggcttgcgcagataaaagcgcggatattcagacgccagcaccggctgcaaatacgtctatttcagcaacacaacaaccagctatccagcaaccgaatgtctccggtaccgtctggatccgtcagaaagtcgcactgccgcctgatgctgtgctgaccgtgacactttctgacgcgtcgttagccgatgcaccgtcaaaagtgctggcgcagaaagcggtgcgtactgaaggtaaacagtcaccattcagctttgttctgtcatttaacccggcagatgttcagccgaacgcgcgtattctgttgagtgcggcgattaccgtgaatgacaaactggtatttatcaccgataccgttcagccggtgatcaaccagggcggaactaaagccgacctgacattggtgccggtacagcaaaccgccgtgccggttcaggccagcggtggcgcaacgactaccgtaccttcgacttcaccaactcaggtgaatccgtcttcggcagttccagctcctacgcaatattaagcgacgttaaccctctccgcccggagagggttagtagttccagcgataacgctgcaagtcgatttgcccgcttcccgataccatcacaccttctgccagtaatgcctgtcgctgacgctgtaaatccggtccggttagcgaaattgtgccgtggcgattaaccacccggtgccagggtaaggtgctgccttcagggagacgctttaacacaccgcccacctggcgcgcggcgcggggcgatcccgccagtttcgccacatcaccgtaagtggtgacatagccttcgggaatagcggcgacgatttgccagacgcgttggggaaatgaatcttctttttccatcttttcttcctgaggtaatttttcagcataatctggaaaaacgcccgagtgaagtcgcattgcgcaagaaaccagcatctggcacgcgatgggttgcaattagccggggcagcagtgataatgcgcctgcgcgttggttctcaacgctctcaatgggggctctgttggttctcccgcaacgctactctgtttaccaggtcaggtccggaaggaagcagccaaggcagatgacgcgtgtgccgggatgtagctggcagggcccccacccatttctgcctcccaccgtttcgtcaaaaaatcccaacatggctaaactttaaccacaactgacgtcgcaagaattgtctggctgcgcagtacgcttcggaggtatgtctgatgaagtatgttgatggttttgtggttgccgttcctgccgataaaaaggatgcctatcgggaaatggccgctaaggctgcgccattgtttaaagagtttggcgcgcttcgtattgtcgaatgctgggccagcgatgtaccggatggcaaagtgaccgattttcgtatggcggtgaaagcggaagagaatgaagaggttgtctttagctggattgaatacccttcaaaagaggtccgcgacgctgctaatcaaaagatgatgtcggacccacggatgaaagagttcggcgagtccatgccgtttgacggcaagcgaatgatctatggcggattcgagtcaatcatcgacgaataggtagcgtgacgggctgtgcggcgtgccgtcagcccaaaaattcacaaatgttgctcggcccagcgtaagaaatcttctttcggtaatgccttgctgtagagccagccctgaccgtagtgcacgccatgctggcgtaaccactcttcttgtttactggtttcgattccctccgctaccattttcagtttcagtgtttttgccatttcgatgatatgcggcgtgacatttttatattccagcgcatcaacgaaagatttatcgatcttcagaatgtcgacatccagatcctgtaaataacttaaacttgaataccccgtaccaaaatcatcaagataaatttcatggcccgcctcccggtagcgagaaattatcggggcgctggttttcggatcggcaaactcgcgttcagtgagttcaagcgcgatctgtctgggattaacctgatagtgattgatcatgtcacgcagcaattgcgggattttttccgaggtgagcacgggggattcaagattgatcgaaatatgctgctgtggatgctgacgcagccagtcgcccatatcttcaaagacgcttcttataatcagtagcgtcaatggctcagaaaggcccgtttgctgtgccagcggaataaaactatctggtgacaaccaactaccgtctgtctgcggccagcgcgccagtgcctcagcaccgacaattttgccattggctaaggagacaatcggctgatagtgcacgcaaatatcacgattttcgatagcatcctgcagccgatgatgcggtgactgaatacggcgcaaaatacgcagcacaaacatcgctgccagcaggccaatcaccaacccgagcggtaaccaaataaagacttgccgatgccagcctttctgcaacattttcgttgaagcccatgtgatgatcgaaatattcatctccggtaagggcaggatatcgtaaatgattccattattttcgatatgctcaccgggtgttttttgtagcctggtaataattccctgagcaatttcatcgctgctggttatgacaacgttatgggcattgccaataatggcggcatcaatttgccatgagctatagggaatgacatcaataaaggaagcggggtcgatcatgacgacataatgtgccgttcccatggcgaccatgtaacggataatgcctaaatcgttatgcgatgttaaccagacacgataaccatctttcgaaattttacctggctcggggaaggtatcgggcggactttcatgctccagagacgaacactggggaacgttgttatcgatataagccacttcctgaatatagcgataactgtaagatacccgacgcatttccatgagatgggcttcgctacaggcagcgccttgccatctttccagctcctgcagcgcatctttcccttgtgtcgccaccttattggctcgaatagcgacgcgggaggaataggtatccagctcttcaataaacgatgtttctacctgctgatgggccagccagatgcttaagccgacaggcagcaatactgaaagaatcagtactcccgaaataaggccgaccagatgtcgtgttctcaccagcatatccttattaacacagtgtagggaaagtatatctgattgtggaaaaaggctggctggagataaggaggtagagctggtatttcatgaagtgatgggtggaaacgatcattgtcatttgaccaggcgcagagctttacgcctggtatgtaaccctaacttaagatgttgattcggcgcgagcgagggtaaaaatatcgtaaaaagacagttcacctttacggacgatcattttttgcagttgttccttatgaacatccgcgacacgcggagagttcaagatggcttcaaccagcgcggcaggtacaaagcgcgtgttgtaccattcgccgttatagcaaacgcggaaatccagcacgtcgatatcttcatagcggtagcgtgggtagacatcgaaaaagaagaaaccattaagcaggataaataatacaaccagtagccagacagagcctgacagcgtttcggactgcaacatcaccgccagggtggcaaaaaaagcaacgtacataccgataaacagccccggatgtttacggataaaactgatactaaagcggggtttgttgtcgcgtttttcgcgggtattcagagactcaatcgtttcggtcagcaggcgttgtatttcggtcatcgtttgccttcgtggtatctgcaactttccagggaacaccctattttaacgtgggaatagtagaggggaagtaacagatctaccacaattttgcataacagttgcgaaaaaccgattacaattttttaattattctggctggattaccgcccacgacaacgttgtccgggacatcttttgtgacaactgcacctgaggctaccacgacgttatcaccaatggtcacaccagggttaatgaccgcgcgtccgccaatccagacgttattaccgatggtgacgggtttccccagttcagcaccgctattacgtgctacagggtcgatgggatgtgttgccgtgtagatatgaacgcctggtgccaacatacagttatcaccgatgcgaatagggcagacatcaagcatcacgcaatcgaagttggcgaaaaaattattaccgagaaaaatgttatagccatagtcacagcgaaacgttggctcaatataagcctctgtcacctgaccgaatagatcagcgagaatttgctggcgtaatgtgtgctcttccgccagggaatgattgtatcggtgaataagctgacgagcgcgcaggcgatcgcgagataacgtctcatctgccgagcgatacaactcaccagcaatcatcttttctttttctgtgctcattactgacctccggttgctgaaaatgcggcaacacagtaagacgaaaagtcagtgaagagaacgttcccattacatctgtgtgataaagatcacatagggtatgtcttcatggcgaaaaagtataaaattcttaataaacagccggttatagctccgaaagcgaattatttattagcgaataaatttccatactgaggaagggatcttgtcgtacagtttattcatggtcaattcggcgaggcggtgatctgcggctgagtaaaataccgccagttcattatctgataattcgtatttatttttctcgataacacgctccagcgtgtcaattgtctggcaacgacgtaaacgcattaaataatcggttttcgttaaaggtttttcggacatacttctacctatggttgtaataattctaacaagataaactcgcaggattctctttcgtcgcattgacaaaacaacggaatagtcgattacctgacttccgccatttctgaagatcctgcatattaataccataactactgaacaacataaaggtgtcatccagatattcgtcgatctgctcaatgagcttattgtcttcattatacttaattttgtaattaagtgcgaaggtcgcaatatgctcaatcagttcattcaactggaggttgatcgccgaggttgggtcgtttacccagccatgattgctttcttcaaggtttgcaaggcagtcatgatacagggtttcacagagaaacttaagctgtgcgatatcatgtcttttgggtgagtattcatccataacgcgtccccttcttagcggttgaactaacggacacctttcgggatggaaaaaacttactgacctggacttgccctctcgtttgttagcttaactataagccactctttgcaggttttcatcgcattattacgaaaaattacaattaggaaggaagcgggacaggactcactttttcatactagcactaacccgcagcaggtaaaagcagtttgctcgaactattcataacatttcaggattatcgccagatgaaattggtgacactaataccaggattgctctgaatatgacgtaataaccgaggaatgaataaagaattaccgcaaataattaagaatagcctctaaatgattatggattattaaatctattagcgctacttaatataaattaactaacaatcagtattttttatgaattttatccgtggttaatactggttttcgtatgagatcctgagttggtggttcaattactccttaatgttcgtaggttatgcataaaaaaggccgcttacgcggccttagtgattacacgttgtatcaatgatgatcgacagtatggctgtgctcgatatcttcattcttgcggctaaagcggcggcgaaccaccacaaagaataccggaacgaagaagattgccagtaccgttgcggtcaccatcccgcccattacaccggtacctactgcgttctgcgcgccggaaccagcaccagtactgataaccagcggcataacgccgaggataaacgccagcgaggtcatcaggatcggacgtaaacgcatccgcaccgcatcaagcgtcgcttcaatcagacctttaccttctttatccatcaagtctttggcgaattcgacgataaggatcgcgttcttcgccgacaacccaatggttgtgagcaggcctacctggaagtaaacgtcattggtcaggccacggaaggtggcagccagcaacgcaccgataacccccagcggaacgaccagcataacggagaacggaatcgaccagctctcgtacagcgccgccagacacaggaacacgacaatcaacgaaatcgcgtacagtgaaggtgcctggttgccggagagacgttcctgataggacatccccgtccagtcatagccaacaccggtaggcagtttgctcgccagttgttccatcagctccattgcttcaccggtacttttacccggtgccgcctggcctaagatttccatggatggcaggccgttgtaacgttccagacgcggcgaaccgtactcccaacgagaagaggagaacgccgagaatggcaccatctgaccatcagcagcacgaacataccagtcgccgatatcatccggcagcatacggtatttcgcttctgacatgacataaactttcttcacacgaccgcggtcgataaagtcgttcacatagctgccgccccatgcagcgcccagagtggtgttaatgtcgttgatagaaacacccagcgcctgcgctttttcctggtcgatatcaatcttaaactgcggggtatcttccagaccgtttggacgtacgctggtcaacatatcagggtgcttcgctgcttctgcaagcaactggttacgcgcctgagtcagtttttcgtgaccaaggccagcctggtcaatcagctcaaagtcaaagccggttgcagtacccagttccacgattgcgggcaggttaaaggcgaaaaccatcgcatctttgatttgcgagaaagcgcgtgttgcacgcatggtaatcgcttcaactttgttttcttcgcccggacgatcggcccagtccttcaaggaaacgaacgcaataccggtattctgaccacgtcccgcaaagccgaagccgttaacggcgaacaccgactcaacgttgttcttttctttggtcagatagtaatgcgttacctcattgagcactttctgtgtacgttcctgcgttgcacctgctggcagctgaaccatggtcataaacacgccctggtcctcatctggcaagaaggagcttggcagacgcacgaacagataggccatgccgaccacgatgatcagatacagcaccaggtaacgccccgtactgcgcagaataccgcctacgctgtcggtgtagtggtgcgtgctcttctcgaacatgcggttaaaccagccgaagaagccttttttaccttccccgtgatcgcctttggcaatcggtttcagcatggtggcacaaagagctggagtcaggatcaacgccaccagtaccgacagcgccattgctgaaacaatggtaatagagaactgacgatagatagcaccagtagaaccgccaaagaaggccatcggtacgaataccgccgacagtaccatcgcgataccgaccagagcgccctgaatctgccccatcgacttacgggtagcttcttttggcggcaaaccttcttccgccataacacgctcaacgttttctaccacaacgatggcgtcatccaccaacaggccgatggcgagcaccatcccgaacattgttagcgtgtttatcgagaagccaaaggcggcaaggacggcaaaggtcccgagcaataccaccggtacggcaatggtcggaatcaacgtcgcgcggaagttctgcaggaacagatacataaccaggaacacgaggatgatcgcttcgaccagcgttttaaccacttcgtgaatagagattttcacgaacggcgtggtgtcgtatgggtaaacaattttcagacccgacgggaagaacggttccatcttcgccagttcagcacggattgccgcagcggtatccagcgcgtttgcaccggtcgccagcttgatccccagaccggaagccggttggccgttaaactctgcgatgatgtcgtagttctcaccacccagctcaatcttcgcgacgtcacgcagcagcacgcgggaaccatcctgattcactttcagcaggattttgccgaactcttcagtagaggtcagacgcgtctgagcaataatagaggcgttaagctgttggcctttcaccggcggcgtaccaccgagctgacccgccgcaacctgggcgttctgcgctttgatggcggtaatgacatcaaccggcgttagctggaatttgttcagctcattcgggttcatccagatacgcatcgcgtactgtgaaccgaacaactgaacatcacccacgcccgacgtacggctgatggcatctttcatattcgccgccacgtagtcggagatatcctcctgcgtcatggtgccatcggtgttgataacgccgacaaccatcaggaagctgctggatgatttctcaacgctcaccccttgctgctgaacttcttgcggcagcaacggcatcgccagctgcagtttgttctgcacctgaacctgcgcgatatccgcatcagtaccagactcaaaggtcagggtgatctgcacggtacccgtggagtcactgttagaggacatgtacatcaggttatcgataccgttcatattctgttcgataacctgtgtcaccgtgtcctgcactgttttcgcatcagcgccggggtaggaggcggagatcgttactgccggcggtgcaatcgtaggatattgcgccaccggcagtttgaggatcgccagcccccctgccaacatgatgataatggcgatcacccacgcaaaaatcgggcgatcgataaagaaattaggcatgtcttaacggctcctgtttaagttaagacttggactgttcaggctgagcaccgcttgcggcttgctggttattatcagcggtaacttcttgtgcttttacctggacaccaggacgcactttctgcagcccacttattactacgcgatcgcctgctttcagaccttctgtcaccagccacttatcgccaatagcctggcttgcaacgatcggacgggtttccactttgtcatccgcgccaactaccagtacggtggcatcgccacgcggcgtacgggttacgccctgttgcgggactaaaatagcgtttggattaagcccttcttccagacgtgcgcgcacgaacatacccggcagcagagtgtgatccgggttcgggaagatagcgcgtagggtgatagacccagtggtctgatcaacggtaacgtcagagaattccagcgtaccgtcctgcgggaacttaatgccgtcactggtgatcagtgacactttggctttgccgttctcttgtttcagcgtgccattcgccagttcctgtttcaggcgcaggaagtcgttgctggactgggtcacatcaacgtagatcggatcaagttgctgcacggttgccagcgcagtcgcctgaccgttctgtaccaatgcgccttccgtcacgttcgacttaccaatgcgaccgctaatcggagaggtgactttggtgtaagccagattgatccgcgcagtttcaacggcagctttcgccgcagttaccgcagcattcgcctgttgcgcatcagccagagcctgatcgtactcttgcttactgatgtactgagtaccgagcagtttctgataacgattcaccgtcaattgcgcgatattggctgcagcctgggctttcgccagatcacctttcgcactgtcgtatgtcgcctgataggtcgcaggatcaatctgatagagagagacacctgcttcgatgtcgctaccttctttgaaattacgcttcaggataatcccgctaacttgaggacgaacttctgcgatccggtaggcactggtgcgacccggaagctcggttgtgatctgcagaggttcagttttgactgttactacgccaacggcgggcatctgctggccaccttgttgggcctgtttgtcgtcacatcctgttagggctaagctgcctgagagcatcagaacgaccgccagaggcgtaaaccctctgtttttgttcatatgtaaacctcgagtgtccgatttcaaattggtcaatggtcaaaagttaataaacccattgctgcgtttatattatcgtcgtgctatggtacatacattcacaaatgtatgtaaatctaacgcctgtaaattcacgaacatatggcacgaaaaaccaaacaagaagcgcaagaaacgcgccaacacatcctcgatgtggctctacgtcttttctcacagcagggggtatcatccacctcgctgggcgagattgcaaaagcagctggcgttacgcgcggtgcaatctactggcattttaaagacaagtcggatttgttcagtgagatctgggaactgtcagaatccaatattggtgaactagagcttgagtatcaggcaaaattccctggcgatccactctcagtattaagagagatattaattcatgttcttgaatccacggtgacagaagaacggcgtcgattattgatggagattatattccacaaatgcgaatttgtcggagaaatggctgttgtgcaacaggcacaacgtaatctctgtctggaaagttatgaccgtatagaacaaacgttaaaacattgtattgaagcgaaaatgttgcctgcggatttaatgacgcgtcgcgcagcaattattatgcgcggctatatttccggcctgatggaaaactggctctttgccccgcaatcttttgatcttaaaaaagaagcccgcgattacgttgccatcttactggagatgtatctcctgtgccccacgcttcgtaatcctgccactaacgaataaccctgaatctgactccaggatttttcctggacattttcgtcgttgctattctggttcactgcgtcgtgatattcttgcggtttgactttttcaggtcgttcttcaggttcagaaaccttcattcatcatgactatgttccagtattacaaacgatcacggcattttgttttttcagcatttattgcttttgtttttgtcttgttatgccagaacacggcgtttgcgcgggcgtcatcgaatggtgatctgccgacaaaagcggacctgcaggcgcaacttgactcactaaataaacaaaaagatctttctgctcaggacaaactggtgcagcaggatctgacagatacattagccaccctcgataaaatcgatcgcataaaagaagagacagttcagctacggcaaaaagtcgctgaagcgccggaaaaaatgcgccaggcgaccgcggcgttaacagcacttagcgatgtcgataacgacgaagaaacgcgcaaaattctgagcacgctgtcgttgcgccagctggaaactcgcgttgcccaggcgctggacgatttgcaaaacgcacaaaacgatctggcgtcttataacagccagctggtttcgttacagacgcagcccgaacgcgtgcaaaatgcgatgtataacgcttcgcagcagctgcaacaaattcgcagtcgtctggatgggactgatgtcggcgagacagccttacgtcccagccagaaagtgttaatgcaggcccagcaggcgttgctgaatgcggagattgaccagcagcgtaaaagcctggaagggaacaccgtcttgcaggataccttgcaaaagcaacgtgattacgtgacggcgaacagcgctcgtctggagcaccagttacaactgttgcaagaagcggtaaacagcaagcgcctgactttaaccgaaaaaacggcgcaggaagccgtctccccggatgaagccgcgcgtattcaggctaatccgctggtgaagcaggaactggaaattaaccagcagttaagtcagcgtctgattaccgcgactgaaaacggtaatcagttgatgcagcaaaacattaaagtcaaaaactggctggagcgggcgctgcaatcggaacgcaatattaaagagcagattgccgtcctgaagggcagcctgctgttgtctcgtatcctttaccagcaacaacaaacgctgccctcggcggatgaactggaaaacatgaccaaccgcatcgcggatttgcgtctcgaacagtttgaagttaaccagcagcgtgatgcactcttccagagcgatgcgttcgtcaacaaactggaagaaggtcacaccaacgaagtcaacagcgaagttcacgatgcgttattgcaagtggttgatatgcgtcgcgaattgctggatcaactcaacaaacagttgggtaaccagctgatgatggccattaacctgcaaatcaaccagcagcagttaatgagtgtgtcgaaaaacctgaaatccatcctgactcagcaaatcttttgggtgaacagtaaccgtccaatggactgggactggatcaaagcgttcccgcaaagcctgaaagatgaatttaagtcgatgaaaatcacggtgaactggcaaaaagcctggcccgccgtttttatcgctttcctcgctggtttgccgctgctgttgattgccgggctgatccactggcgtctgggctggctgaaagcgtatcaacaaaaactggcttccgctgtgggttccctgcgtaacgacagccagctcaacacaccaaaagcgatccttatcgacctgatccgtgcgctgccggtgtgcctgattattctcgcggttggcctgattctgttgaccatgcagctcaacatcagcgaactgctatggtcgttcagcaaaaaactggcgatattctggctggtgtttggcctgtgctggaaggtactggagaaaaacggcgttgccgtacgtcacttcggcatgccggaacagcagaccagccactggcgtcggcaaattgtccgcatcagtctcgcattgctgcctatccatttctggtctgtggtggcagaactttccccgctgcatctgatggatgatgtgctggggcaagcgatgattttcttcaacctgctgctgattgccttcctggtatggccgatgtgccgcgaaagctggcgtgataaagagtcgcacaccatgcgactggtcaccattaccgtgctgtcgataatcccgattgcgctgatggtgctgactgctacaggctacttctacactacgctgcgtctggcaggacgctggattgaaaccgtttatctggtgatcatctggaacctgctgtaccagacggtactgcgtggcttaagcgtagcggcgcggcgtatcgcctggcgtcgtgcgctggcgcgtcggcagaatctggtgaaagagggcgcagaaggtgctgaaccgccggaagaacccaccattgcactggagcaagttaaccagcagacgctgcgtattaccatgttgctgatgtttgcgctgttcggtgtcatgttctgggcaatttggtccgatttgatcaccgtgttcagctatctcgacagcatcacgctctggcattacaacggcactgaagctggcgctgcggtggtgaaaaacgtcaccatgggcagtctgttgtttgcgattatcgcctcaatggtggcctgggcgttgattcgcaacctgcctggtttactggaagtgctggtgctctcgcgactgaatatgcgccagggcgcgtcgtatgccattactaccatccttaactacatcattattgctgttggtgcgatgacggtgttcggatcgctgggcgtctcttgggataaactccagtggctggccgcagcattatccgtaggtcttggttttggtttacaagaaattttcggtaacttcgtctccggtttgatcattctattcgaacgtccggtgcgtattggcgatacggtaaccattggtagcttctcggggacggtaagtaagatccgtattcgtgcgacaacgattaccgatttcgatcgcaaagaagtgatcatcccgaacaaagcgtttgttaccgagcgtctgatcaactggtcgttgactgacactactacgcgtctggtgatccgtctcggcgtggcctatggctccgatctggaaaaagtgcgtaaagtgttactgaaggcggcgactgagcacccaagggtgatgcacgaaccaatgccggaagtcttctttacggcatttggtgccagcacgttggatcatgagctgcgtctgtatgtgcgtgaactgcgtgaccgtagtcgtactgtcgatgagctgaaccgtactatcgatcagctgtgccgtgaaaacgacatcaacattgcctttaaccagcttgaagtgcatctgcacaacgagaagggcgatgaggtgacggaagtaaaacgcgactacaaaggcgatgacccgacgccagcggtagggtaaaaacgaaagggggcaacatttagttgccccgagattgctaacaaagtgcgcgttgttcatgccggatgcggcgtgaccgccttatccggcctacgaaaccgcaagaattcaatatattgcaggagcggtgtaggcctgataagcgtagcgcatcaggcagttttgcgtttgcccgcaaccttaggggacatttagcgaccccatttatttctcacttttccgcctcatcatcgcgcgttaatttcttttcataatcacgctttacaatatccagcgcgcgcagcacggtactggcagggatctgattttcctccagcagcacaatcaaatcgacagccagtttgacatcgtcaggggcattttccagtgacatattctctccattgctagcgggttaaacgcgctaacctgttttcgattttttccagcgcatggcggcagcgtgccaggcgcgcttcataggcttccacttcacgatgcagcgtttgctgttccacgagatcggtcacccgcgccagacgggctctgcgttcggcaaccatctcacgtagccgccgctcaaaatcctgatgctgaatacgtttacgctgccagcgggcaattttcggtggtgcactgtcccactcgcgcaatgaccaggcggaggcttcacgcgcgatggcttccagttgtgccgccagatgttccgccagccaggccacttgcggcagctgttgctgctcaactgcatgacgaagcgcagccagattatcgcccgcctcgtcgagacaagcctgtagtgttgtcgcacgagtctgaaaaagatgcctgtcgaaacgagcacttagcgtggcgaactgtgacaccggggcacaacgctgacgcagcgtagcgagctgtccttccagtttttccagcagcagggcggttttcacgataagacctcaatgaaaatgataattgttatgctaaagtagccactctgtaagctgacaacactcaatatgcaacgaatcattttaatcatcattggctggctggcggtagtgctgggtacgctgggcgtggtattaccggtattaccgacgacgccgtttatcctgctggcggcctggtgctttgcccgttcttccccgcgctttcacgcctggttgctgtaccgctcatggtttggcagctatctacgtttctggcagaaacatcatgcgatgccgcgcggcgtcaaaccgcgggcgattttgcttattttgctcacgtttgccatttctctgtggttcgtccagatgccatgggtgcgcatcatgttgctggtaattctcgcctgtttgcttttctatatgtggcgaattccggtgattgatgaaaagcaagaaaagcactgaagcacaacaatcgcagttgcaattattgcgtacagccagtacattctggcgttttcgagcacaggcgcaggcggtcaaaggttaaacaactgttacttttgatacgtttaaaacgcgccgtgagtaccaccgtaacaagcaggcatacacttatgaccgcgactgcacagcagcttgagtatctcaaaaatagcatcaaaagcattcaggactacccaaaacccggcattcttttccgcgatgtcaccagcttactggaagacccgaaagcttacgctctcagcatcgacttgctggttgagcgttacaaaaatgcgggcattaccaaagttgtcggcaccgaagcgcgtggcttcttgtttggcgctccggtagctctgggtctgggcgttggctttgtaccggtccgtaaaccgggcaaactgccgcgtgaaaccatcagtgaaacttacgacctggaatacggcaccgatcagctggagatccacgttgatgccatcaaaccgggcgacaaagttctggtggtggacgacctgctggcaaccggcggcactatcgaagcgaccgttaaactgatccgtcgtctgggtggtgaagtggctgacgctgcgttcattatcaacctgttcgatctcggcggcgaacagcgtctcgaaaaacagggcattaccagctacagccttgtcccgttcccgggccattaattatcgccagtcttgtgctgcccacgctacggacagcacaagatgtgcattcagcctcgccgttctgacggggctgtgttagcattaccccttcgtgaatccaccttccagcgtttcagagcctgccaatgagttatcaggtcttagcccgaaaatggcgcccacaaacctttgctgacgtcgtcggccaggaacatgtgctgaccgcactggcgaacggcttgtcgttagggcgtattcatcatgcttatcttttttccggcacccgtggcgtcggaaaaacctctatcgcccgactgctggcgaaggggctaaactgcgaaaccggcattaccgcgacgccgtgcggcgtgtgcgataactgtcgtgaaatcgagcaggggcgctttgtcgatctgattgaaatcgacgccgcctcgcgcaccaaagttgaagatacccgcgacctgctggataacgtccagtacgctccggcgcgtggtcgtttcaaagtttatctgatcgacgaagtgcatatgctgtcgcgccacagctttaacgcactgttaaaaacccttgaagagccgccggagcacgttaagtttctgctggcgacgaccgatccacagaaattgccggtgacgattttgtcacgctgtctgcaatttcatctcaaggcgctggatgtcgagcaaattcgccatcagcttgagcacatcctcaacgaagaacatatcgctcacgagccgcgggcgctgcaattgctggcacgcgccgctgaaggcagcctgcgagatgccttaagtctgaccgaccaggcgattgccagcggtgacggccaggtttcaacccaggcggtcagtgcgatgctgggtacgcttgacgacgatcaggcgctgtcgctggttgaagcgatggtcgaggccaacggcgagcgcgtaatggcgctgattaatgaagccgctgcccgtggtatcgagtgggaagcgttgctggtggaaatgctcggcctgttgcatcgtattgcgatggtacaactttcgcctgctgcacttggcaacgacatggccgccatcgagctgcggatgcgtgaactggcgcgcaccataccgccgacggatattcagctttactatcagacgctgttgattggtcgcaaagaattaccgtatgcgccggaccgtcgcatgggcgttgagatgacgctgctgcgcgcgctggcattccatccgcgtatgccgctgcctgagccagaagtgccacgacagtcctttgcacccgtcgcgccaacggcagtaatgacgccaacccaggtgccgccgcaaccgcaatcagcgccgcagcaggcaccgactgtaccgctcccggaaaccaccagccaggtgctggcggcgcgccagcagttgcagcgcgtgcagggagcaaccaaagcaaaaaagagtgaaccggcagccgctacccgcgcgcggccggtgaataacgctgcgctggaaagactggcttcggtcaccgatcgcgttcaggcgcgtccggtgccatcggcgctggaaaaagcgccagccaaaaaagaagcgtatcgctggaaggcgaccactccggtgatgcagcaaaaagaagtggtcgccacgccgaaggcgctgaaaaaagcgctggaacatgaaaaaacgccggaactggcggcgaagctagcggcagaagccattgagcgcgacccgtgggcggcacaggtgagccaactttcgctaccaaaactggtcgaacaggtggcgttaaatgcctggaaagaggagagcgacaacgcagtatgtctgcatttgcgctcctctcagcggcatttgaacaaccgcggtgcacagcaaaaactggctgaagcgttgagcatgttaaaaggttcaacggttgaactgactatcgttgaagatgataatcccgcggtgcgtacgccgctggagtggcgtcaggcgatatacgaagaaaaacttgcgcaggcgcgcgagtccattattgcggataataatattcagaccctgcgtcggttcttcgatgcggagctggatgaagaaagtatccgccccatttgatcgtaagcacagcttacgttcgtcatccttaacgtgattgagagagaaacctatgtttggtaaaggcggtctgggtaacctgatgaagcaagcccagcagatgcaagaaaaaatgcagaaaatgcaggaagagatcgcgcagctggaagtcaccggcgaatctggcgcaggtctggtaaaagtgaccatcaacggtgcacacaactgccgtcgcgtagagatcgacccgagcctgctggaagacgacaaagagatgctggaagacctggtggctgcagcattcaacgacgcagcacgtcgtattgaagaaacgcagaaagaaaaaatggcctctgtatcctccggaatgcagctgccgcctggctttaagatgccgttctgatgcaaaccagcccgctgttaacacagcttatggaagcactgcgctgtctgccgggcgttggcccgaagtcggcgcagcgtatggcgttcacgctgcttcagcgcgatcgtagcggcgggatgcgtctggcgcaggcgctcacccgggcgatgtcggaaatcggccactgcgccgattgccgcactttcaccgaacaggaagtctgtaacatctgttcgaatccgcgtcgtcaggaaaacggtcaaatctgcgtggtggagagtccggcggacatctacgccattgagcagacggggcagttttcaggtcgttattttgtgttgatggggcatctgtcaccgctggacggcatcggtccggatgatatcgggcttgatcgtctggaacagcgtctggcagaggaaaaaatcactgaagtgatcctcgccaccaaccccacggttgaaggtgaagctaccgctaactacattgccgagctttgcgcgcaatatgacgtggaagccagccgaatcgctcatggcgttccggttggcggcgagctggaaatggtcgacggcaccacgttgtcacactcccttgccgggcgtcataagattcgtttttaagcaaacgagagcaggatcacctgctctcgcttgaaattattctcccttgtccccatctctcccacatcctgtttttaaccttaaaatggcattattgaggtagacctacatgaaaggacaagaaactcgtggttttcagtcagaagtgaaacagcttctgcacctgatgatccattctctctattccaataaagaaatcttcctgcgtgagcttatctctaacgcctccgatgcggcggacaagctgcgtttccgtgcgctctctaacccggacctgtacgaaggtgatggcgaactacgcgttcgtgtctctttcgataaagacaagcgtacgctgaccatctccgataacggcgtggggatgacccgcgacgaagtgattgaccatctggggactatcgctaaatccggtaccaaatcattcctcgaatccctgggttctgaccaggcgaaagacagccagctgatcggtcagtttggtgttggtttctactctgcgtttatcgtggccgacaaagtgaccgtgcgtactcgcgcggcaggcgaaaaaccagaaaatggcgtcttctgggaatcggctggcgaaggtgaatacaccgttgccgacatcaccaaagaagatcgtggtactgaaatcaccctgcatctgcgtgaaggcgaagacgagttcctcgatgactggcgcgtgcgttccatcatcagcaaatactccgaccatatcgcgctgccggtagagatcgaaaaacgcgaagagaaagacggcgaaaccgttatctcctgggagaaaatcaacaaagcgcaggcgctgtggactcgtaacaagtcggaaatcaccgatgaagagtacaaagagttctacaaacacatcgcccacgactttaatgatccgctgacctggagccacaaccgtgttgaaggtaagcaggagtacaccagcctgctgtacatcccgtcccaggctccgtgggatatgtggaaccgcgatcataaacacggcctgaaactgtatgttcagcgtgtgttcatcatggacgacgcagaacagttcatgccgaactatctgcgcttcgtgcgtggtctgattgactccagcgatctgccgctgaacgtttcccgtgaaatcctccaggacagcacggtaacgcgtaacctgcgcaatgcgctgaccaagcgtgtgctgcaaatgctggaaaaactggcgaaagacgacgcggaaaaataccagaccttctggcaacagtttggcctggtactgaaagaaggtccggcggaagatttcgctaaccaggaagcgatcgccaaactgctgcgttttgcttctacccataccgattcttctgcgcagaccgtatctctggaagactacgtttcccgcatgaaagaagggcaggagaaaatctactacatcaccgcagacagctatgcggcagcgaagagcagcccgcacctggaactgctgcgtaagaaaggcatcgaagttctgctgctttccgaccgcatcgatgagtggatgatgaactatctgactgagttcgacggtaaaccgttccagtcggtgtctaaagttgacgagtcgcttgaaaaactggctgacgaagttgatgagagcgcgaaagaagcggagaaagcactgactccgttcatcgaccgtgtgaaagccctgctcggcgagcgcgtgaaagatgtccgtctgactcaccgtctgaccgatacgccagcgatcgtttcgaccgacgcggacgaaatgagcactcagatggcgaaactgttcgctgcggcgggccagaaagtgccagaagtgaaatacatcttcgaactgaacccggatcacgtactggtgaaacgtgcggcagatactgaagatgaagcgaagttcagcgagtgggtagaactgctgctggatcaggcgctgctggcagaacgcggcacgctggaagatccgaacctgtttattcgtcgtatgaaccagctgctggtttcctgatgtaatgccggatgaccttcgtgtcatccggcatttttcttttcatcatctgcactttccgcaaattatctcgccattaaccgtttcagccccaggtgcctttcttgaggcaatcgcctgttggtggtatcgtttatcgctttttcaaaaaattcgacacattttaaggggattttcgcaatgcgtatcattctgcttggcgctccgggcgcggggaaagggactcaggctcagttcatcatggagaaatatggtattccgcaaatctccactggcgatatgctgcgtgctgcggtcaaatctggctccgagctgggtaaacaagcaaaagacattatggatgctggcaaactggtcaccgacgaactggtgatcgcgctggttaaagagcgcattgctcaggaagactgccgtaatggtttcctgttggacggcttcccgcgtaccattccgcaggcagacgcgatgaaagaagcgggcatcaatgttgattacgttctggaattcgacgtaccggacgaactgatcgttgaccgtatcgtcggtcgccgcgttcatgcgccgtctggtcgtgtttatcacgttaaattcaatccgccgaaagtagaaggcaaagacgacgttaccggtgaagaactgactacccgtaaagatgatcaggaagagaccgtacgtaaacgtctggttgaataccatcagatgacagcaccgctgatcggctactactccaaagaagcagaagcgggtaataccaaatacgcgaaagttgacggcaccaagccggttgctgaagttcgcgctgatctggaaaaaatcctcggctaattcgaaagcgcgcacggacagtcccctcgccccctcggggagagggttagggtgaggggaacaggcccgcacaagcaaacttatcagcaatctcaggccggatattcattcggccttttacaaaaacctcaatctgcgctattcctttttctgatttgacctctcacagcaattagttcttcttcctcacttttccgctacaattatcaacaagttgaatcgataagaggcggtaatgcgtcagactaaaaccggtatcctgctggcaaacctgggtacgcccgatgcccccacacctgaagcggtaaaacgctatctgaaacaatttttaagcgacagacgcgtggttgatacctcacggttgttatggtggccattgctgcgcggcgtgattttgccgctgcgctcgccgcgtgtggcgaagctgtatgcctctgtctggatggaaggtggctcgccgctgatggtttacagccgccagcaacagcaggcgctggcacaacgtttaccggagatgcccgtagcgctgggaatgagctacggctcgccatcactggaaagcgccgtagatgaactcctggcagagcatgtagatcatattgtggtgctgccgctttatccgcaattctcctgttctacggtcggtgcggtatgggatgaactggcacgcattctggcgcgcaaacgtagcattccggggatatcgtttatacgtgattacgccgataaccacgattacattaatgcactggcgaacagcgtacgcgcttcttttgccaaacatggcgaaccggatctgctactgctctcttatcatggcattccccagcgttatgcagatgaaggcgatgattacccgcaacgttgccgcacaacgactcgtgaactggcttccgcattggggatggcaccggaaaaagtgatgatgacctttcagtcgcgctttggtcgggaaccctggctgatgccttataccgacgaaacgctgaaaatgctcggagaaaaaggcgtaggtcatattcaggtgatgtgcccgggctttgctgcggattgtctggagacgctggaagagattgccgagcaaaaccgtgaggtcttcctcggtgccggcgggaaaaaatatgaatatattccggcgcttaatgccacgccggaacatatcgaaatgatggctaatcttgttgccgcgtatcgctaaagctgagcggtaaagaactgagcgccgtcgcgaagagcctcgtcggcggttttcatcatccgtgaataatgcaaaaaggcgtgcagcgtgcctgggtagagtttgaactcacagggctgctgatgcgccgctaacgtctggtaaagcagacggctgtcatccagcagcggatcgaactccgccccggcaataaaacagggcggaacttcgcgagtgagatcattattaaacagacagtaatacggcgactcgcggtccgcgtcgttgcttaaatatgcctcttcgtacatctgcaaatcctgttgcgttaagccatcccagacaccgcccaacagacgacgagtcacggaatcccgtaatccgtaaagcccataccacagcaaaacgcccgcaactttaccgcaatcgatctgtttatcacgcaaccacaacgcactggcgagcgccagcatggcacctgcggaatcaccggcaaagccaatgcgggacatattgatttgataatcctccgcctgctggtggaaataacaacaagcagccacaatttcctctatcgcttgcggaaaacgcgcttcaggtgaaagggtgtaatcaataccaatcaccgtacattggctgtagcttgccagcaggcgcatgatgcgatcgtgggtatcgagattgccgagaataaaaccgcctccatgcaaataaaatagcgtcgctgggctatctggctgcggacaaaagagacgtgtttccacctgcccatattttgttggaaccatgtaagctctggttgccatttctggagcgcccgcattccagaatcggcgctcaagcgtgtaatactgtcgttgctcagcaatcgttcccgttgcgggccagggcggtaaatccggctgaagagtattcacaacggtcttcatttcagcagaaataaggtccagaacaggtagtttgttttccggcttcatacaaaaactcctttcaaattacgtcattgtaaggaaccactgccatgaaaatgcgatcccgcctgctgatattgaaactggctgcgtctcgcgcgctcccgtcagattgtgttaacattcgccgctcagttaaccacccgtaaaaacaaccatgaaatttcccggtaaacgtaaatccaaacattacttccccgtaaacgcacgcgatccgctgcttcagcaattccagccagaaaacgaaaccagcgctgcctgggtagtgggtatcgatcaaacgctggtcgatattgaagcgaaagtggatgatgaatttattgagcgttatggattaagcgccgggcattcactggtgattgaggatgatgtagccgaagcgctttatcaggaactaaaacagaaaaacctgattacccatcagtttgcgggtggcaccattggtaacaccatgcacaactactcggtgctcgcggacgaccgttcggtgctgctgggcgtcatgtgcagcaatattgaaattggcagttatgcctatcgttacctgtgtaacacttccagccgtaccgatcttaactatctacaaggcgtggatggcccgattggtcgttgctttacgctgattggcgagtccggggaacgtacctttgctatcagtccaggccacatgaaccagctgcgggctgaaagcattccggaagatgtgattgccggagcctcggcactggttctcacctcatatctggtgcgttgcaagccgggtgaacccatgccggaagcaaccatgaaagccattgagtacgcgaagaaatataacgtaccggtggtgctgacgctgggcaccaagtttgtcattgccgagaatccgcagtggtggcagcaattcctcaaagatcacgtctctatccttgcgatgaacgaagatgaagccgaagcgttgaccggagaaagcgatccgttgttggcatctgacaaggcgctggactgggtagatctggtgctgtgcaccgccgggccaatcggcttgtatatggcgggctttaccgaagacgaagcgaaacgtaaaacccagcatccgctgctgccgggcgctatagcggaattcaaccagtatgagtttagccgcgccatgcgccacaaggattgccagaatccgctgcgtgtatattcgcacattgcgccgtacatgggcgggccggaaaaaatcatgaacactaatggagcgggggatggcgcattggcagcgttgctgcatgacattaccgccaacagctaccatcgtagcaacgtaccaaactccagcaaacataaattcacctggttaacttattcatcgttagcgcaggtgtgtaaatatgctaaccgtgtgagctatcaggtactgaaccagcattcacctcgtttaacgcgcggcttgccggagcgtgaagacagcctggaagagtcttactgggatcgttaagttatcgtcggttcgtaggccagataaggcgttcacgccgcatctggcatttggctctcgatgcctgatgcgacgctggcgcgtcttatcatgcctacatatttttcatattttacatccggcaaccaccgtttaccccgtcaccacctcacccgccggtggcgtttccagcagttccagcatggtacgggcgatttcacgctcgcccatcactacctgattcgcaccacgttcggtgatatacgccacttcatcgtcataatgggcgcgggcaataatctcaatatccggatttttcgcgcgggcagatgccacaatctcacccgcttcataaccgttgggaatcgtcaggatcagccattttgcacattccagatgcgccagttgcataatttcttcgttcgccgcattgcccaatactgcgcggaccccgcgctctcgcagctcatcaacacgggttcgtgacgtctcaatcaccaccagcggaatatcagaggcgagcaatttctcccccagcaggctgcctacacgaccgtaacccaccagtagcgcatggttgcaaatatccactgggatctgcttctcttcttcgattgcctcttccagcgtctgctcttccagcgtttcggtcttcgccagatatttctccagtagtgcgaacagtaccgggttgagcataatcgacaggatcgcccctgccagtaccaggttttgtccggcctgcggcagtaaattcaatgccattcccagtcccgccaggataaacgcgaactcaccaatctgcgccaggctggcggcgatggttaatgccgtacgttgggagtgaccaaacagtcgcaccaggaaaaatgcggctaacgacttaccaaacagaataatcgccagcgtcgccagcactgccagcggttgctgaatcagaattaacggatcaaacaacatcccgacggagacaaaaaacagcaccgcaaacgcgtcgcgcaatggcagcgtatcgtgggcggcacggtgactcagttcagactcgttcagtaccatcccggcaaagaacgcaccgagtgcaaaggagacatcaaacagctctaccgcaccaaaggcaacccctaacgccagcgccagcaccgacagggtaaacagctcgcgagaaccggttgccgcgctgcgtgccataatccacggcaccagacggcgacctaccagcatcataatggcgataaatgcgatcactttgccgatggtgatccccatatcgactgcaagagtggcaaagcccacatcgccctgttccatcattcctgccactgcgggcagcaacaccagcgtcagaaccattaccaggtcttccacaatcaaccaaccgatggcgatttgcccacgctgactgtcaattaattgccgttcttcaagtgcgcgcagtaacaccacggtactggcggtggaaagacataaaccgaacacgataccggtcattaacgaccagcccagcacggcagagagcgccatacccagcagcgtcgccacggctatctgggcgatcgcaccgggaatggcgatggcctttaccgccatcaaatccttcagcgaaaagtgcaaaccgacgccaaacatcaacagaatgacgcccagttcagccagttccggggcaagcttggtatcggcaacaaagcccggagtgaatggtcctgccagcacacccgctaacagatatcccaccagaggagaaatacgtagtttattggccagcatgccgaggataaaggcgagcacaaggccgccaacaatggtggtgataagcggggtggcgtgatgcattccgtctccttttcctggtggttattgtccatttttggccgggaaaaccaaaattacaggtaatagtttatgacaatttcattgatgatgttcatgaataattattgaattttgcagaaaaatggaattagctgcaaaaaaagcacggatcggaaaacagaaggcggtttaacagaggaaaggcttatggcgactgtaaaacgatgcagccaaagtttgcctttggctgcaatgaaatcagtctttatgccggttatcaggcaggaatatggtcaacatccccaatagtggcaggaaagcacagattttatagactaactcgatgctggtgtgatcggcgataagccccagaactgccgctcccagacctcccatgccaaaagcaaaaccgaaaaagagtccagaaaccataccgatacgtcctggaagcagctcctgagcgtagaccagaatggcagagaatgccgaagcgaggataaatccaataatcaccgttaaaacccccgtccagtgcaggctggcgtagggtaaaatcagcgtaaacggcgcaacgccgaggatagagccccaaatcacatatttccgcccaattttatcccctacaggcccgccgatcaccgtacctgccgcaacggcaaacaggaaggcaaacagatgaagctgagcattctggatagataatccgaatttttgcatcagataaaaggtgtaatagctgctgatgctcgccatatagaaatatttcgagaaaatgaggattaacagaatgctgaccgccagtacaactttattgcgcggcagtggattgataatcgtcgctttgggttttcctttattcattcggtgctgtgccgagtaccaacggctgatttgcgccaacaccacgatcgccagcagtgccgcaagcacaaaccaggcaacgttgcctttgccataaggcgcgataatcaccgccgccagcaagggtcccagggaactgccaaagttgccgccgacctgaaagatagattgcgccaggccatgccgcccgccggaagccatacgggccacgcgagaagattccggatgaaagaccgatgaaccggtaccgaccagcgccgccgccagcagaactgcgccaaaactgcccgccagcgcaagcagcaccagaccgcttaaggtaaagcacatgccaattggcaacgaccatggcatcggatatttatcggtccagtagccgaccactggttgcagtagcgaagaggcgagctggaaggtgagggttatcatgccaatctgcataaatgtcagagaaaattctgactgaagcagcggataaatcgccagaatcagcgattggatcatgtcgttcagcagatgtgagaggctgatagcacctaaaataccaaacgatgttcgggccttggtcgttgacgcagccgcgcccgccacaggctggggttgttcactcattgccataggaaagtcactttttcagggttgcgatgtaaagaatgatcttatttgtgattattaccagactaacatacctgtatgcgtcgtctgaaggaagtctcaacgccgaatacagaatttctaatctggatgcagatttatcttcaccggacgcagacttgtctatgatgtcgcgtcatactatttttcaacacgttgaaatcaggtcagggagagaagtatgaaattattgcagcggggcgtggcgttagcgctgttaaccacatttacactggcgagtgaaactgctctggcgtatgagcaggataaaacctacaaaattacagttctgcataccaatgatcatcatgggcatttttggcgcaatgaatatggcgaatatggtctggcggcgcaaaaaacgctggtggatggtatccgcaaagaggttgcggctgaaggcggtagcgtgctgctactttccggtggcgacattaacactggcgtgcccgagtctgacttacaggatgccgaacctgattttcgcggtatgaatctggtgggctatgacgcgatggcgatcggtaatcatgaatttgataatccgctcaccgtattacgccagcaggaaaagtgggccaagttcccgttgctttccgcgaatatctaccagaaaagtactggcgagcgcctgtttaaaccgtgggcgctgtttaagcgtcaggatctgaaaattgccgttattgggctgacaaccgatgacacagcaaaaattggtaacccggaatacttcactgatatcgaatttcgtaagcccgccgatgaagcgaagctggtgattcaggagctgcaacagacagaaaagccagacattattatcgcggcgacccatatggggcattacgataatggtgagcacggctctaacgcaccgggcgatgtggagatggcacgcgcgctgcctgccggatcgctggcgatgatcgtcggtggtcactcgcaagatccggtctgcatggcggcagaaaacaaaaaacaggtcgattacgtgccgggtacgccatgcaaaccagatcaacaaaacggcatctggattgtgcaggcgcatgagtggggcaaatacgtgggacgggctgattttgagtttcgtaatggcgaaatgaaaatggttaactaccagctgattccggtgaacctgaagaagaaagtgacctgggaagacgggaaaagcgagcgcgtgctttacactcctgaaatcgctgaaaaccagcaaatgatctcgctgttatcaccgttccagaacaaaggcaaagcgcagctggaagtgaaaataggcgaaaccaatggtcgtctggaaggcgatcgtgacaaagtgcgttttgtacagaccaatatggggcggttgattctggcagcccaaatggatcgcactggtgccgactttgcggtgatgagcggaggcggaattcgtgattctatcgaagcaggcgatatcagctataaaaacgtgctgaaagtgcagccattcggcaatgtggtggtgtatgccgacatgaccggtaaagaggtgattgattacctgaccgccgtcgcgcagatgaagccagattcaggtgcctacccgcaatttgccaacgttagctttgtggcgaaagacggcaaactgaacgaccttaaaatcaaaggcgaaccggtcgatccggcgaaaacttaccgtatggcgacattaaacttcaatgccaccggcggtgatggatatccgcgccttgataacaaaccgggctatgtgaataccggctttattgatgccgaagtgctgaaagcgtatatccagaaaagctcgccgctggatgtgagtgtttatgaaccgaaaggtgaggtgagctggcagtaatccgaaagtgccggatgtttgcatccggcacaatgcttaatcgcggcgggcgatatcagcaaatttggcatcgaggatctttgccagatcgcctgccgccagttcgatatccagtccgcgcttgccgccggaaacataaatagtggcaaattcttgtgcgggggcgtcgataatcgttggcagacgttttttctgccccagtgggctaatccccccaaccaggtatcccgtcgaacgctgcgcgaccatcggatcggccatctcaactttcttggcacccagcgcttttgctacttttttaagatccagttgacctgcgaccggcgtaacggccacggcaaggtgtttcatatcaccgttcactgccaccagcagcgttttgtagacctgatccggattcaaacctaattttttgacgacttcatcgccaaaattggtttcagccggatcgtgctcgtaggtatggatttgaaacgaaatcttgtttttttcgagtaatttaactgcgggtgtcatggtaattttcctgccttaaacaaaaaaacgaagcaagcatacgcctgatggcggtccaaaaaaaagagtcatcttgcctaagagtattggcaggatggtgagattgagcgacaatcgagttacaccgtcgcttaaagtgacggcataataataaaaaaatgaaattcctctttgacgggccaatagcgatattggccatttttttagcgcaacatttgcggcaaattcccttctccatacaggtgtagtgcaccgaccgcgaccacatatcgccccggcggcatggcgcgtaatttatcccgccaggcgagatttcgctgatgcatcagcacatcgtacagcgactgactgaacgtattgggcagcgttatatcattattttgcggcggtgcattcagccaccagctcatcatttgttgcagcaaccgtgcgttggtatgccagtgggtcagcgtatcgtccagcagcgccagtcctttgtcagggagctggagcaacatggcaatctggttttcagccccttccagttcaatcacgggtttatgttgttgcttcgccgcctgcaatagctggtaatcgataccgtattctgcccgcagccccagtttttgtgcctgcgtcgcctgaagaaccatcgcgatttgccacagcggttgggtagaaaagagtgagggagaaatgcccatctcctggctaatgtgctgcaggttttggagttgctcctcgctaatgcgctcttccagcgcctcgcaggcaggcaaattagcaaaaggcgtatcgctggtggaaacatccgcctcgacgatcagcgcatcggcgtttttgagctttttgagcaaacgggtgggcaggggagccatatcgtggctacccatatgaatactgccaatcagatgaaaatggcgattgccggggagggtgatatcgatggcaggccaggtgtaatgattaccgcgcagcgcggcccaaagcgtttttacccggtacaacagatccatacgacctccctttgtgaaatatcatgctagcgcgcggtgagggatggcgcaaatggagttggagacttgtttaatgtgtttgtatgattcagtatgttcttgcatcgctattcacaaggaagcaacagttaaaaaccatgaaacaggcaacaagaaaaccgacgacacccggagatattcttctctatgaatatctggaaccgctcgatttgaaaatcaatgagttagcagagttgctgcatgttcatcgtaatagcgtcagtgcactgatcaataacaatcgtaaactcactactgagatggcatttcgtctggcgaaagtttttgataccacagtcgatttttggctaaacctccaggcggcggttgatctttgggaagttgaaaacaacatgcgcacccaggaagaattgggacggattgaaacagtggctgaatatttggcacgccgtgaagagcgtgcaaaaaaggtcgcgtaaggccaaaacatcgcttcatctcgtaggccggataaggcgttcacgccgcatccggcatccgagcaccattgcctgatgcgacgcttacccgtcttatcaggcctacaaacttgtgcctgaaccgtaggccggataaggcgtttacgccgcatccggcatccgagcaccattgcctgatgcgacgcttacgcgtcttatcaggcctacaaacctgtgcctgaaccgtaggccggataaggcgtttacgccgcatccggcagtcatgcgtcgatgccaaatgcgccaccctaaagcagcgcatccgcaatgatgtacttattccttcggtttaaaccgcagcaaccggttggcgttactcactacggtaatcgacgagagcgccattgccgctccggcaactaccgggttaagcagtgttccagtgaacggccacaaaataccggcggcgaccggaataccgatactgttgtagataaacgcaccgagcaggttctgcttcatgttgtgcagcgttgcgcgggaaatagcgagcgcatccgcaacgcccatcaggctatggcgcatcagggtaatcgccgcggtttcaatggcaacatcactgccgccacccatcgcaatgccgacatccgcctgagccagcgctggcgcgtcgttaatgccgtcgcccaccattgccacctgacgtccttcactttgcagatgtttgatcgcttcggctttaccgtccggcagcaccccggcgatcacctcatcaatccctgcttctttggcgatcgcattggcggtggttgggttatccccggtcaacatcaccagacgatatcccgctttatgcaggcgttgcagcgccgccacgctatcactacgcaacggatcgcgtactgccagcagggctaccgctttcccgtcaaccgccagcagcacaggcgttgccccttgcgatgcctgagcagtaatctccgcttcgatagctttggtaccaacctgttgctcatttaacagcgcctgattgcccagcaataacgcatgaccttcagcttcaccgctcacgcccagcccgcgcaatgtgcggaaaccgttgacctgcggtagctgcatatcacctgctttatcgaggatcgctcgtgccagcggatggctggaaccttgctccagtgccgccgccagacgcaatgcctgcgcttcatcaacatcagcaaatgttttcactgcgacaacctgcggcttcccttcagtcagcgtcccggttttatcgaacactacagtgtcgagtgtactggcgcgttgcagcgcgtcagcgtcccgcaccagcacgccaaactcagccgcccgcccgacgccggaaataatcgacatcggcgtcgccagccccagcgcacacggacaggcaataatcagtaccgtggtggcaatcaccagggtatagacaatctgcggtgccggaccaaagaaataccagattgccgcactgacaagcgcaataaccaccactaccggcacaaatacggctgagattttatccgccagctgaccgatttctggcttgctgctctgggcctggcgcaccatgcgaatgattcgtgacagcgtagtatggctgccaaccgcactggcacgaaacagcacactgccgtcctgtaccactgtcccggcatggacgctatcgccttcgcctttttgctgcgggattggttcgcccgtcagcatcgcttcatccagccatgcttcgccctgggtaatctcgccatctaccggcacgcgatcgccggtcgtcaggcgcagcaacatacctggctgcacttctgccagaggcacgcttttttcaccttcgtcagtaaccaggcgtgccgtcggcggggttaaatcgagtaacttttccagcgccttagaagaacgctggcgtgcgcgcgcttccagcatatggccgagattgatcagaccgataatcatcgcgctggcttcgtaataaagatgtcgcgcttccatcgggaaccactgcggccacaggttgacgctcatcgaatagagccacgccacgccagtacccagcgccaccagcgtatccatcgtcgccgcaccgttcagcaggcttttccatgcactgcggtaaaaatggccgccggcgaaaaccatcactgccagggttatcaggccgataaccaaccacaggctgcggttgtcagcggtgaccatcatgttatcgccgatcatcccccagaccatcaccgggatacccaccgccagtgcgacaattgcctgccagcggaagcgcttcatcgtagcgacggcggtttcttgctggcgctcgcggcgtttagcgtcatcttcaatcgcttccgcgccgtagcccgctttttccaccgcctgcactaaatcttgtggggaggcactgcccatcaccagcgcagtacgctccgccaggtttacccgtgcctgagtgacgcccggtacgctttgcagcgcattttgtacgcgggtgacacagctggcgcagctcatgccgctcagcagcaactgctggctgtcatcgtcatcggcggtcgctgccggaagcgcctcagaaaccgctgtcagtgcttccgacgggattgatgactccgccagcggtttagcctttgggtggcttacagatgcgtcataacccgcttgtttgatggtttcgatcagctgttctgcactggcagtcccggtaacgtgcgcttcagtgatagacacatccgcctgctcaacatccggacgctgttcaagactttctttcacgcgtttaacgcagtgaccgcaggacaggccgtccagggtcaggtcgatagtttgtgacataaaacactcctttaagacagttttgactggctgtgataaaggttaaaccttccagcaaggggaaggtcaagaaattaataaaccaggcgggtaaaagtccgtaaagattaaaaaatcggctcgatttgcatcaggattagacatttatctctttgttttcctgtagttaagttgcgggtgctaagttaaatcaggatgcctgaaaatcggcaccggggtgaggaattacctcccgcatctataaaaaggagttaacaaaagatgttagatgcaaacaaattacagcaggcagtggatcaggcttacacccaatttcactcacttaacggcggacaaaatgccgattacattccctttctggcgaatgtaccaggtcaactggcggcagtggctatcgtgacctgcgatggcaacgtctatagtgcgggtgacagtgattaccgctttgcactggaatccatctcgaaagtctgtacgttagcccttgcgttagaagatgtcggcccgcaggcggtacaggacaaaattggcgctgacccgaccggattgccctttaactcagttatcgccttagagttgcatggcggcaaaccgctttcgccactggtaaatgctggcgctattgccaccaccagcctgattaacgctgaaaatgttgaacaacgctggcagcgaattttacatatccaacagcaactggctggcgagcaggtagcgctctctgacgaagtcaaccagtcggaacaaacaaccaacttccataaccgggccatagcctggctgctgtactccgccggatatctctattgtgatgcaatggaagcctgtgacgtgtatacccgtcagtgctccacgctcctcaatactattgaactggcaacgcttggcgcgacgctggcggcaggtggtgtgaatccgttgacgcataaacgcgttcttcaggccgacaacgtgccgtacattctggccgaaatgatgatggaagggctgtatggtcgctccggtgactgggcgtatcgtgttggtttaccgggcaaaagcggtgtaggtggcggtattctggcggtcgtccctggagtgatgggaattgccgcgttctcaccaccgctggacgaagatggcaacagtgttcgcggtcaaaaaatggtggcatcggtcgctaagcaactcggctataacgtgtttaagggctgatcatgatgaacacggaaggtaataacggtaacaaacctctcggtctatggaacgtcgtttccatcggcattggggcaatggtgggggcggggatcttcgcgctgctggggcaggctgcattgctaatggaagcctcgacctgggtcgcctttgcttttggcggtattgtggcgatgttttccggttatgcctatgcgcgtctgggggcgagctatcccagcaatggcggcattatcgacttctttcgtcgcggattaggcaacggcgtcttttcgctggcgctctcgttactgtacctgttgacgctggcggtgagcatcgccatggtcgcccgtgcttttggcgcttatgccgtgcagtttttgcatgaaggcagccaggaggagcaccttattttgctctacgcgttggggatcattgcggtgatgacgcttttcaactccttaagcaaccatgcggtagggcggctggaagtgatcctcgtcggcattaaaatgatgatcctgttattgctgattattgccggtgtctggtcgctgcaaccggcgcatatttccgtctctgcgccccccagctccggtgcgttcttctcctgtattgggataactttccttgcctatgcgggctttggcatgatggcgaacgcggcggataaagtgaaagatccgcaggtcattatgccacgggcgtttctggtggcgattggcgttaccacgttgctttatatctcgctggcactggttttgcttagcgatgtatcggcattagagttagaaaaatatgccgataccgccgtagcgcaggctgcttctccgctgctcgggcatgtgggttatgtgatcgtcgtcatcggcgctttactggcgacggcttcagccattaacgcgaacctgttcgccgtgtttaacatcatggacaacatgggcagcgaacgcgaactgccgaagctaatgaataaatccctgtggcggcagagtacctggggcaacattattgtcgtggtgttgattatgctgatgacggcggcactgaatttaggctcactcgccagcgttgccagcgccacctttttgatttgctacctggcggtgtttgtggtggcgatccgcctgcgtcatgatattcacgcctcgttgccgattcttatcgttggtacgttggtgatgttgttggtgatcgttggctttatctacagtctgtggtcccagggtagccgtgcgttgatatggattattggctcactcttactcagccttattgtggcaatggtcatgaagcgcaataaaaccgtataacatctctctgtgcgcagtacttcctgtattattgtggtggcggtcgatattcgcactggcaaaaaaacgtgcttgaatatctgttgaaaccctttaacaaagcacaggaggcgttgcgcgaacgatgaacatcagcgatgtagcaaaaattaccggcctgaccagcaaagccattcgcttctatgaagagaaggggctggtgacgccgccgatgcgcagcgaaaacggttatcgcacctacacgcagcagcatctcaacgaactgaccttactgcgccaggcacggcaggtgggctttaacctggaagagagcggcgagctggtgaatctgtttaacgacccgcagcggcacagcgccgacgtcaaacggcgcacgctggagaaggtggcggagatcgaacgacacattgaggagctgcaatccatgcgcgaccagctgctggcactggcgaatgcctgccctggcgatgacagcgccgactgcccgattatcgaaaatctctccggctgctgtcatcatcgggcagggtgattaagacgagacggctcggatatgtagggttatcccttctatcgcaatgacttcaacatgcgtacctgcaccgagatcctcgctggcgctgacaggccatgaactgtcaccgacgcgcatatgaccgcgcccgttgaccagcggagattccagcacaaaacgtcggccaatcagctgctgcccgcgctggtttaaatgactatcgctgtgcttttgttcgcgcacccgccgcgacaaccatttccaccacagccaggcggcgagcagcgtcaggatggcaaacattaccccttgccactcccaacccagcggcaccagccagaccaccaggccggtaatcaccgctgccacgccgctccacaacaaataaccatttccgcccagcatctcggctgccagcagcaaaccgccgagactgagccagaaaatatgtggatgaacgaccattaactccatcatggctgagtccgtttgttggcgctgtctttcaccagctcggcaatcccggcaatcgaccccatcaggctgctggcctctaatggcatcatcactactttgctgttactggaggaaccgatctgctgtaacgcttcggtgtatttctgcgctacgaagtagttcaccgcctgaatatcaccggaggcgatagcttcagacaccattttggtggcgcgggcttctgcttcggcggaacgttcacgcgcttcagcctgtaaaaacgccgactgacgttcgccttccgctttcaggatttgcgactgtttttcaccttcggctttgaggatttccgcctgacggatcccttccgcttcaagaatgtaagcgcgtttggtacgttccgctttcatctgcgcgttcattgaagagataagctctgccggtgggcgcacgtcgcgaatttcaatacgggtgactttaatcccccacgggttggtggcttcatcgacaatacgcagcaggcgtgagttgatgctgtcgcgctgagagagcatttcgtcaagttccattgaacccagcacggtacggatgttagtcatggtcaggttgatgatcgccagctccagattgctgacttcataagccgcgcgcggcgcgtcaatcacctgaataaagcacacggcgtcgatggtaacgttggcgttatctttcgagataacttcctgggaagggatatcgagcacttgctccatcatattgatcttgcgaccaatgcgatccataaacggcaccaccagactgagccccggctgtaacgttttggtatagcgaccaaagcgttctactgtccactgatagccctgcggtacgattttgacacccgcgccgacaatgaccagcgcgacaaaaatgagaatcgggataaagataagcatcggaaaaacctcctgttgtaccgtccataatcagcaaaattgctgcttgattaaacaaattatacctgattactgaaagagagttcccccttattcctgcgaaggataaactgtttttagtaaaaatcagaaaaagggaacagcgatgcaggaaaatagtcctttgcttcagctacaaaacgtaggatatctggcgggtgatgcgaagattcttaataacatcaatttttcgctgcgtgctggcgaatttaagttaattaccggtccttctggttgtggcaaaagtacgctgctaaaaatagttgcttcattgatcagcccaaccagcggaacgttactgtttgaaggtgaggatgtcagcacactaaagccagaaatctaccgccaacaagtctcttactgcgcccagacaccgacgctgtttggcgatacggtatacgataatctgatctttccctggcagatccgtaaccggcagcctgacccagccatttttctcgattttctcgaacgcttcgccttgccggacagcattttgacgaagaatatcgccgagctatctggtggtgaaaaacaacgcatctcattgattcgtaacctgcaatttatgccgaaggttttattgctggatgaaataaccagtgcgctggatgaaagtaataaacataacgtcaatgagatgatccatcgttatgtgcgcgagcaaaatattgccgtgctgtgggtgacacacgataaagacgaaattaatcatgcggataaagtgattacactgcaaccgcatgccggagaaatgcaggaagcacgctatgaactcgcataatattactaacgaatcattagcactggcattaatgctggtggtggtggcaatcttaattagccataaagaaaaactggcgctggagaaagatattctctggagcgtcgggcgagcgataattcagctgattattgtcggctatgtgctgaagtatattttcagcgtggatgatgccagcctgacattattgatggtgttatttatctgctttaatgcggcgtggaacgcgcaaaaacgcagtaaatatattgctaaagcttttatctcatcgtttattgccattacggtcggggcgggaattaccctggcggtgctgattctctcagggtcgattgaatttatcccgatgcaggtgatccctatcgccgggatgattgccggtaacgccatggtagcggtggggttgtgttacaacaatttagggcaacgggtcattagcgaacagcaacagattcaggagaaactgagtcttggtgcgacgccgaagcaggcttcagcgatattgattcgcgacagtattcgcgcggctttaattccgacggtcgattcagcaaaaacggttggcttagtgagtttaccaggaatgatgtccgggctgatatttgccgggattgatccggtgaaggcgattaaatatcagattatggtgacctttatgctgctctcaaccgccagcttgtcgaccattattgcctgctatttaacctatcgtaagttttataattcgcgccaccagttggtggtgacgcaattgaagaagaaatgatgcgatgccggatgcgcagcatcgcatccggcgttgtggttcatgtgccgatcaacggaatatcaatacaacaatgcatacagctggcggcgatacttcgacgccagtgcatcacccgtacccagcgcagcgaggatctcctggaacgttttacgcgtctgaccgtctgcggcggtgagatctttacgcagatgcccgaacagcaactccagcgcctcttcattgcgcccaacctgatgcagttgcagcgccagttgcgtcgccagtgcggcatcttctggattctccgccacctgctgttgcaactgttgaatttccggcgtatcagccgcctgcttcagcagttcgatttgcgccaccagcccctggtagcgggtgtcctgatcctgcaacggaatggttttcagcaccgcttccgcatcttcagaacggttcagcgcaatcagcgtttctgccagcagcaggccgatctccccgttctgattcgacaactgccaggcgtctttcagcaatggcagggcatcggtgtaattgctttcctgcatcagttgcatcgcctgctgcgctttcagctcttcttcgcgcggcagcactttatccagcagggcgcggatcgcctcttccggttgcggcccctggaagccatctaccggttgcccgttctggaacagatacacggtcggaatcgcacgcagaccaaactgcgcggcaatcatctgctccgcgtcgcagtccagcttcgccagaataaattgcccgttgtactgcgccgcgaggctttccagaattggggttaactgcaaacagtgctggctacgttcagaccaaaaatagaacagcaccggagtggtcatcgactgttcaagaacctgttgcaggttagattcgttaatgttgacaatattttctacggacatggagtcgctctctgttgtcgatattttctttgacatgggggcttaagcgcgcgcttcaactcacccctgcaatattttgtccatcacgcgccccggcagcaggcgcttaagcaccattaccgcccaggtcaccagcgtcaccggatagcgcatcttcggcttctcgctaataaaagcatggcgtactttgtccaccaccgcttccggtcccaacgtaaagcgggcggcgatgccgggattttcgactggtttatcactttgcgtctggttgacgttgtcggtgaagcgagtacgaatgggaccgggttcgatcaggctgactttaattccgctgtggcgcagctccatgcgcagtgcatctgaccacgcctccagcgcatatttactggccgcgtaagcgccacgacccggcgtggagattaatcccatcaccgatgatgtcatcacaatacgcccttcaccgtgcggtaacatcgcgggtaacaggcgcatggtgagctggtgtgcgccgaaaaagttggcggaaaactgctgttccatctgcgcacggctgatggtggaaagggggccatacatgccgaatccggcattgttaaagatcccatacagacaattatcggtcagggcgatcacctcgtcggctgcgcgatcaacactttctggtgaatccagatcgatcaacacgccggtaaatcccatgctgttcatgcgctcaacatcatccggtttccggcaacctgccagcacatgaaaaccctggcgttttaattcgagcgcgctttccaggccaattccactggaacatccggtaattaagaccgatttttgcataactttacctgtcaggatctccgttgctttatgagtcatgatttactaaaggctgcaactgcttcgccatccagtcggcaataaacggctgggcgtcgcggttgggatgaataccgtcatcctgcatccattgtggcttgaggtagacctcttccataaaaaagggcagcagcggaacatcaaactctttggcgagtttggggtaaatggcgctaaaggcttcattataacggcgaccatagtttgcaggcagacgtatttgcattaacaatggttcagcgttggcggctttgacatcctgcaaaatctggcgcagcgtttgctcggtttgctgtggctgaaaaccacgcaaaccgtcattgccgcccagttcaaccagcacccaacgcggctgatgctgtttcagcagagccggaaggcgcgccagtccttgttgcgaggtgtcgccgctgatgctggcattaactaccgacgttttactctgccacttatcattcaacaaggcaggccaggccgcgctggcagacattcgatacccggcgctcaggctatcacccagaatcaataacgtgtccgctgcggcggcacggaaggttaacaggaccaggaacaggaagggcaaatgccagcggaaaacattgttgaagttcatcatcttaagaagtccgtcggtcagggggagcatgaactctccatcctcaccggagttgagctggttgtcaaacgtggcgagaccatcgcactggtgggcgagtcgggatcgggtaagtcaaccttgctggcgatcctcgccgggcttgatgacggcagcagtggcgaagtgagtctggtgggacaaccgctacataatatggacgaagaagcgcgggcaaagttgcgcgcgaagcacgtcggctttgtttttcagtcatttatgttaattcctacccttaacgcgctggaaaacgtcgagcttccggctctgctgcgcggtgagagtagcgcggaaagtcgtaacggggcgaaagcgttgctcgaacagttagggctgggtaaacgtctggatcatcttccggcacagctttccggcggtgaacagcaacgagtggcgctggcacgagcctttaatggtcgacctgatgtgctgtttgccgacgaacccaccggcaaccttgaccgccagacgggcgataaaattgccgacctgctgttttccctcaaccgtgaacatggcaccacgttgattatggtgacccacgacctgcaactggcggcacgctgcgaccgctgcttacggctggtgaacgggcagttgcaggaggaagcatgattgcacgttggttctggcgcgaatggcgttcgccgtcgctattaattgtctggctggcgctaagcctggcggtggcctgcgtgctggcgctgggcaatatcagcgatcgcatggagaagggcttaagccagcaaagccgtgagtttatggcgggcgatcgggcgttgcgcagttcacgcgaagtgccgcaagcgtggctggaggaagcgcaaaagcgcggcctgaaagtcggcaagcagctgactttcgccacaatgacctttgcaggcgacacaccgcagctggcgaacgtcaaagcggtggatgatatctacccgatgtatggcgatctgcaaactaatccccctggcctgaaaccgcaggcgggcagcgtattgctggccccacgcctgatggcactgcttaacctgaaaacgggcgacaccattgacgtgggcgatgccaccttgcggattgccggagaagtgattcaggaaccggattccggttttaaccccttccagatggctccgcgtctgatgatgaatctggcggatgtcgataaaaccggagccgtgcagccggggagtcgggtcacctggcgttataaattcggcggcaacgagaaccagctcgacggctatgagaaatggttgttacctcagcttaaacccgaacaacgctggtacggtctggaacaggacgaaggcgcgctggggcgatcgatggaacgctcgcaacagttcctgctgctttcggcgcttctgaccttgctgctggcagtggcagcggtggcggtagcgatgaatcattactgtcgcagtcgctacgatctggtggcgatcctcaaaacgctgggggcagggcgagcgcaactgcgtaagctaatcgtcggtcagtggttgatggtgctgacgctttcagccgttaccggtggggccataggcctgttgttcgaaaacgtgttgatggtgctgctcaagcccgttctgcctgctgcactaccgccagccagcctctggccgtggctgtgggcgcttggcaccatgacggtcatctcgctgctggtggggctacgaccatatcgcttgttgctggcaacgcagcctttacgcgtattacgtaatgatgtggtagcgaacgtctggccgctgaagttttatctgccgattgtcagtgtggtggttgtgctgctgctcgccggattaatgggtggcagcatgctgctttgggcggtgctggcgggcgcggtagtactggctttgctgtgcggtgtgctgggctggatgctgctgaatgtacttcgccgcatgacgctgaaatcgctgcctctgcgcctggcggttagccgcctgttacgtcagccgtggtcaacgttaagtcagctttcggcattttcgctctcctttatgctgctggcactgctgctggtgttgcgtggcgatctgctcgaccgctggcagcagcagctacctccagaaagcccgaactactttttaattaacatcgccacagaacaggtagcaccgctaaaagcgttcctcgcggaacatcagatagtcccggaatcgttttatccggtggtgcgggcgcggctgacggcgattaacgataagccgacagaaggtaatgaagatgaggcgcttaaccgcgaactcaatcttacctggcaaaatacgcggcccgatcataatccgattgtcgccggtaactggccgccaaaagccgatgaagtgtcgatggaagaggggctggcgaaacgcttaaacgttgccctcggtgataccgtgacttttatgggcgatacccaggagttccgcgctaaagtgaccagcctgcgcaaagtggactgggaaagtctgcggcctaatttctattttattttccctgaaggggcattagacgggcaaccgcagagctggcttaccagtttccgctgggagaatggcaacggcatgttgacacaactcaaccgccagttcccgaccattagcctgttagatattggcgcgattttaaaacaggtcggtcaggtgctggagcaggtaagtcgggcgctggaagtgatggtggtactggtcaccgcctgcggtatgttgctgttgctggcacaggtgcaggtgggaatgcgtcagcgtcatcaggagctggtggtgtggcgcacactcggtgcggggaaaaaactgctgcgtaccacgttgtggtgtgagttcgccatgcttgggtttgtttccggcctggtggccgcaattggtgcggaaacggcgctggcagtgttgcaggcgaaagtgtttgattttccgtgggagccagactggcgattgtggattgttctgccgtgcagcggagcgctgctgctgtcgcttttcggcggctggctgggtgcgcgactggttaagggtaaggcgctgttcaggcagtttgcggggtgatgagagtaaataaggggcgttctggttgaatggaacgccttgtttaaattaattctacaatatgtttcattgatgatgttattgaattggtgatttcctatctttctattgctgatattaatctgaatcggtggagtttattgattttaaatatagccctacaaaaataactcagactaataaaatcataaatcatatgcgttgaatggatattatccatatagtgaatttgttgatgatgaattcatctgtgctaaaaatgttagtttaataaaatattgaaagtgacctgtaataacagttgttgttgattgagaacaaataagtttatgtgaaaaatatataaatacattagctggtcttgtgtgtcattttatttttttttgttgctaacacagggatatgaacaataactaaaagggcactttatatgagcggaaaaccagcggcgcgtcagggagatatgactcagtatggcggtcccattgtccagggttcggcaggtgtaagaattggcgcgcccaccggcgtggcgtgctcggtgtgtccgggcgggatgacttcgggcaacccggtaaatccgctgctgggggcgaaggtgctgcccggcgagacggaccttgcgctgcccggcccgctgccgttcattctctcccgcacctacagcagctaccggacgaagacgcctgcaccggtgggcgttttcggccccggctggaaagcgccttctgatatccgcttacagctacgtgatgacggactgatactcaacgacaacggcgggcggagcattcactttgagccgctgctgccgggggaggcggtgtacagccgcagtgagtcaatgtggctggtgcgcggtggtaaggcagcacagccggacggccatacgctggcgcggctgtggggggcgctgccgccggatatccggttaagcccgcatctttacctggcgaccaacagcgcacaggggccgtggtggatactggggtggtctgagcgggtgccgggtgctgaggacgtactgccagcgccgctgccgccgtaccgggtgcttaccgggatggcggaccgcttcgggcggacgctgacgtaccggcgtgaggccgccggtgacctggccggggaaatcaccggcgtgacggacggtgccgggcgggagttccgtctggtgctgaccacgcaggcgcagcgtgcggaagaggcccgcacctcttcgctatcttcttctgacagttcccgccctctctcagcctcagcgttccccgacacactgcccggtaccgaatacggccccgacaggggtatccgcctttcggcggtgtggctgatgcacgacccggcatacccggagagcctgcccgctgcgccactggtgcggtacacgtatacggaagccggtgaactgctggcggtatatgaccgcagcaatacgcaggtgcgcgctttcacgtatgacgcgcagcacccgggccggatggtggcgcaccgttacgcgggaaggccggagatgcgctaccgctacgacgatacggggcgggtggtggagcaactgaacccggcagggttaagctaccgctatctttatgagcaggaccgcatcaccgtcaccgacagcctgaaccggcgtgaggtgctgcatacagaaggcggggccgggctgaaacgggtggtgaaaaaagaactggcggacggcagcgtcacgcgcagcgggtatgacgcggcaggaaggctcacggcgcagacggacgcggcgggacggaggacagagtacggtctgaatgtggtgtccggcgatatcacggacatcaccacaccggacgggcgggagacgaaattttactataacgacgggaaccagctgacggcggtggtgtccccggacgggctggagagccgccgggaatatgatgaaccgggcaggctggtatcggagacatcgcgcagcggggagacagtacgctaccgctacgatgacgcgcacagtgagttaccggcgacgacaacggatgcgacgggcagcacccggcagatgacctggagccgctacgggcagttgctggcgttcaccgactgctcgggctaccagacccgttatgaatacgaccgcttcggccagatgacggcggtccaccgcgaggaaggcatcagcctttaccgccgctatgacaaccgtggccggttaacctcggtgaaagacgcacagggccgtgaaacgcggtatgaatacaacgccgcaggcgacctgactgccgttatcaccccggacggcaaccggagcgagacacagtacgatgcgtggggaaaggcggtcagcaccacgcagggcgggctgacgcgcagtatggagtacgatgctgccggacgtgtcatcagcctgaccaacgagaacggcagccacagcgtcttcagttacgatgcgctggaccggctggtacagcagggcggctttgacgggcggacgcaacgttatcattatgacctgaccggaaaactcacacagagtgaggatgagggacttgtcatcctctggtactacgatgaatcggaccgtatcactcaccgcacggtgaacggcgaaccggcagagcagtggcagtatgatggccacggctggctgacagacatcagccacctgagcgaaggccaccgtgttgccgtccactatggctatgacgataaaggccgcctgaccggcgaatgccagacggtggagaacccggagacgggggaactgctgtggcagcatgagacgaaacacgcatacaacgagcaggggctggcaaaccgcgtcacgccggacagcctgccgccggtggagtggctgacgtatggcagcggttacctggcgggaatgaagctgggcgggacgccgctggtcgagtatacgcgggacaggctgcaccgtgagacggtgcgcagcttcggcagcatggcaggcagtaatgccgcatacgaactgaccagcacatacacccccgcaggccagttacagagccagcacctgaacagcctggtatatgaccgtgactacgggtggagtgacaacggcgacctggtgcgcatcagcggcccgcgacagacgcgggaatacggctacagcgccacgggcaggctggagagtgtgcgcaccctcgcaccagacctggacatccgcatcccgtatgccacggacccggcgggcaaccggctgccggacccggagctgcacccggacagtacactcacagtgtggccggataaccgcatcgcggaggatgcgcactatgtctaccgccacgatgaatacggcaggctgacggagaagacggaccgcatcccggcgggtgtgatacggacggacgacgagcggacccaccactaccactacgacagccagcaccgcctggtgttctacacgcggatacagcatggcgagccactggtcgagagccgctacctctacgacccgctgggacggcgaatggcaaaacgggtctggcggcgggagcgtgacctgacggggtggatgtcgctgtcgcgtaaaccggaggtgacgtggtatggctgggacggagacaggctgacgacggtgcagactgacaccacacgtatccagacggtatacgagccgggaagcttcacgccgctcatccgggtcgagacagagaacggcgagcgggaaaaagcgcagcggcgcagcctggcagagacgctccagcaggaagggagtgagaacggccacggcgtggtgttcccggctgaactggtgcggctgctggacaggctggaggaagaaatccgggcagaccgcgtgagcagtgaaagccgggcgtggcttgcgcagtgcgggctgacggtggagcaactggccagacaggtggagccggaatacacaccggcgcgaaaagctcatctttatcactgcgaccaccggggactgccgctggcgcttatcagcgaagacggcaatacggcgtggagcgcggaatatgatgaatggggcaaccagcttaatgaggagaacccgcatcatgtgtatcagccgtaccgtctgccagggcagcagcatgatgaggaatcagggctgtactataaccgtcaccggtactacgatccgttgcaggggcggtatattactcaggacccgatggggttgaaagggggatggaatttatatcagtatcctttaaatccactacaacaaattgaccctatgggattattgcagacttgggatgatgccagatctggagcatgtacggggggagtttgtggtgttctttcacgtataataggaccaagtaaatttgatagtactgcagatgctgcgttagatgctttgaaagaaacgcagaatagatctctatgtaatgatatggaatactctggtattgtctgtaaagatactaatggaaaatattttgcatctaaggcagaaactgataatttaagaaaggagtcatatcctctgaaaagaaaatgtcccacaggtacagatagagttgctgcttatcatactcacggtgcagatagtcatggcgattatgttgatgaatttttttcaagtagcgataaaaatcttgtaagaagtaaagataataatcttgaagcattttatctcgcaacacctgatggacgatttgaggcgcttaataataaaggagaatatatttttatcagaaatagtgtcccgggattgagttcagtatgcataccgtatcatgattaattttagtgcttttattagtggggcctataaggagattcaatgaaatatagttcaatattttcgatgctttcattttttatactatttgcctgtaatgagacagctgtttacggttctgatgaaaacattatttttatgaggtatgtggaaaaattacatttagataaatactctgttaaaaatacggtaaaaactgaaacaatggcgatacaattagctgaaatatatgttaggtatcgctatggcgaacggattgcagaagaagaaaaaccatatttaattacggaactaccagatagttgggttgttgagggagcaaagttaccttatgaagttgcgggtggtgtatttattatagaaattaataagaaaaatggatgtgttttgaatttcctacatagtaaataatgctggcgctgatggatgcggatggaaacattgcgtggagcggggagtatgatgagtggggcaaccagctgaatgaagagaacccgcatcacctgcaccagccgtaccggctgccggggcagcagtatgataaggagtcggggctgtactacaaccggaaccggtactacgatccgttgcaggggcggtatatcactcaggacccgatagggctggaggggggatggagtctgtatgcgtatccgctgaatccggtgaatggtattgatccattagggttaagtcccgcagatgtagcgctaataagaagaaaagatcaactaaaccatcaaagagcatgggatatattatctgatacttatgaagatatgaagagattaaatttaggtgggactgatcaatttttccattgtatggcattttgtcgagtgtctaaattaaatgacgctggtgttagccgatcggcgaaagggctgggttatgaaaaagagattagagattacgggttaaatctgttcggtatgtacggcagaaaagtaaagctatcccattctgaaatgattgaagataataaaaaagacttggctgtaaatgaccatgggttgacatgtccatcaacaacagattgctcagatagatgtagtgattatattaatccagagcataaaaaaacgataaaggctttacaagatgctggctatctcaagtaatctatcaaagatgataatatttatttttgctattataatcattgttgttttatgcgtaattacttatctttatttatacaaagatgaatctcttgtaagtaaacattacataaactatatggcaataccagaaaatgatggagtttttacatggctcccagatttttttccgcacgtagcggtggatatatcaatatacacaaatgtagaagatgattatttttttcttatttttccctaacaaatgatgatgggggtaggtttaagaaaacattgacagtgagggccagggaacaagtggcgaaaatcgtatcaaagaatgatccagatacaaaaaaagtgtggtgtaaatatggtaagataccagggcaaggggatggtgtaaaccttttttttgttggtgaaattaatgttacgcattattttataacaaatattggagctggattgcctgatgcttgtgcagagtaattgcttgaattaagagtctatcccatatcgaagtcgtcaacttcgtagtgaggaaaagtaaaattcctgactgagaaaagacatgtcggctattgtgtaaagccatatagctcagacgatgaatatctactcgtattcagttgtttattgagggtgagttccgaccctgaaacaacaaataaaatgaacagtcagagagtttacatagaattgcactggtcttttacgatatctgacattgtgtaatacatattcagccatgcattaattaaaatgttacgtgtttaatgtgagtccctatctgaaaataaataatccttccggattaaaataaattcttgccgggaaagaaagaggaaataaaccattagcggaaaaccagcggcacgccagggtgacatgccccagtacggcggcccgatagtccagggttcagcgggggtactgatagtcgcgccgactgcatcgagaactccatacaactttttacggaacgtcacctgataaaatttgttcagtatcgtcttttgagattctcaaggttatggagtaaccagacagaacggacaccactgtcggagataaaaaccccctgtttacgcagctcgttgctggcccggtgctgaccatgtgtcgggaaagcgacggcgtaatcaacaacagcctgttcagttgcctcatcggtacggttcttaaggttaggagcgcggcgactacgattaatctgcgcatccacaccgccttcagcgaccagttcgcggtaacgataaaacgtatcacgcgaaacgcccatgattttacaggcttttgatacgttgctgagttcttcagccagattgagcaaaccggctttgtgtttgatgacgggattggcagtatgaagcatgagagttacctcttgttttggataaggattcgacactcatatcaaaaccggtaactctcaacctttcaaggccatgtgtcagatcaagtcgcgactaatacaaatacgtccctcattaccgcgccttaacccattccgccacttccgcccactcaccgcgaaagacaactttttccgcttttttctcaagctgatagcgatacatcgggtcgtaatattcttcaagtaacggcaccagccaggccagatgaccgtcggtgctgccggtggtgagttgcgttgtcagtgctgcatccagccttgcagccagttcgttatagcgctgtagccccagccgacgcttaatcgccgaaagtccgtgatgcaggtattcgcaatactcctgccagccctgttcgtcgccgtacgcgtgggtaaaatcatgatgcatacgcaagaaatactcttcgttcaggcgctcaagacggatctcaaacggatcttctaccaccgcaatcgccgcctgagtcattcgctcgcgcaggcattccggcaggtgattcgaaccgatcatccggctttcgtcttccagcacccacaggcgcaaattctgacgggcgtcggtttttagcatttcggcagccagcaggttttcaaaactcgcctggctaagttgtggttgtaacgtgcgaccaaacgccgaaccgcgatgacgcgccaacccttccagatcaacaccgttcggctgttgctgcactaacagcgttttaccgctgccggtacaaccgccaatcagcactatcggtttttgtgccagttcaatagtcgcctgaatcgcggtctggcgcagtgccttataaccgccttccaccagcggataatcaatccccgctgcatgcaaccagctttgcacaatatgtgagcgctgaccgccacgggcgcagcagagaataccttgcggattttgcaggcacgctgcccgccaggcgtccatgcgctgctgacgaatttcacccgccaccagtttatgtcccagcgccagcgctgcgtctgagccttgctgtttatagcaggtgccaacggcggcgcgttcatcgttattcattaacggcagattgatagcggcgggcattgcgccgtgctcaaactcgataggggcgcgaacatcaataatgggcgtatcagcaatcagcagggcacgatagtcctgttccgtgtgtctctcttgcatagttaaaagtgaacctcaaatcagcttgcgcgctattttacgcgccaacgcgcaaggaaacttgatttttaactgcgtgggttgccgaaaatttctaaaaatccgctgatttccggcctgcgctgggtaaacaaggtcacaatatcttctaccgctttgccgctgccaaatttgcgccatgccagactcaatggcgaaggagggcgcatcgttgggattacccggctgaccagttgttgattatcgatcattgactggcaaagcgattttggcaaaaaaccaatgccaacgcccgccagatgggcggcgattttcgtttccatatcgggaacaataatctctttttgccctggcaatcgccaggcgacgcgtttggttaaggtgcgggcgctgtcttcaatattgaccgccggaaagcgccgcaactgcgcttctgttagcggctcttcaacgttcgccagcggatgatccgccgccatgacaaagcgccattgcaccgatcctaagggatcaagactaaaggtatttgccagcgcctcagttcccgtgacgccgatagccagcgaaaaaccttcgtacaatagcgagtcccagacgcccatatagatttgtcgggagatgtgaaactgggtaaaggggtaacgctcattcagccacgccagcaactgggcgacggcctgggggttgtagagcaggttgttgatgacaatattcacctggcgttccacgccatcattcacctgttgcagctcgcttggcatactttccagccagctcagccagtctctggcctgggaaagtagatgctcgccagccgctgtcaacgtcacgctgcgagtcgtacggaaaaacagcgctactccggtattctcttccagaagtttaatgcgataactgatcgtcgccgtggttttacataatcgttctgccgcttttgaaaaacttcctgtttcagcaaccgcaatgaaagtccgcaaggtttctggatcgaacatcttcaggtatccccttttaaatccgcaagttgcgtgattttcttatcctctgatttatcagtatttttacatgataaccctgttcaatttgtggactaaatctagttttggaaaaatattccaacttttgtattgatgttgttctcttaaggttttagattgcctgttattgaaaccaagctgaccggtcggcggtggttgaacggaattatgttacaaggacaaaaagatgaaacttcaggtattaccgttaagtcaggaagcctttagtgcttatggcgacgtaatcgaaacgcagcaacgggattttttccatattaacaatggcctggtggagcgttaccacgatttggcgctggttgagattcttgagcaagactgtacgcttatcagcattaaccgcgcgcaaccggcgaatctgccgctgaccattcacgaactcgaacgtcatccgctgggtactcaggcctttatcccgatgaaaggtgaggtgtttgtggtggtcgtggcgttaggtgacgacaaaccagacctgtcaacgctgcgggcgtttatcaccaacggcgaacagggagtgaattaccatcgtaacgtctggcatcacccacttttcgcctggcagcgcgtcaccgattttctgaccatcgatcgcggcggcagtgacaactgtgatgttgaaagtattcctgaacaggaactctgttttgcgtgacgcctgcaaccgacttgcataagataaactaattgttcattgtttatgctcacttgtaggtcggagttaacgtaggtatgacggaagttagacggcgcggcaggccaggacaggcggagcctgtggcacagaagggcgcacaggcgttagagcggggaattgcgattctgcaatatttggaaaaaagtgggggaagttcgtcggttagcgatatttctctcaatctggatttgccgctctccacgacctttcgcttgctgaaggttttacaggcagcggattttgtctatcaggacagtcaattaggctggtggcatataggattaggtgtctttaacgtcggtgcggcgtacatccataaccgcgatgtcctctccgtcgccgggccgtttatgcgccgcctgatgttactttccggcgaaacggtcaatgtcgcgatccgtaacggcaatgaagcggtattaattggtcagttagagtgtaaatcgatggtcaggatgtgtgcgccactgggcagtcgtctgccactgcatgcttccggtgcgggcaaagcgctgctttatccgctggcggaagaggagttgatgagcatcattctgcaaaccggtttgcagcagtttacgccaactacgcttgtggatatgcccaccttgctgaaggacctggaacaagcgcgtgaactgggctataccgtagataaagaagagcatgttgtaggtctgaattgcatagcttcagcaatttacgatgatgtcggtagtgttgttgccgctatctccatctccgggccttcatcaagactgacagaagatcgttttgtcagtcagggtgagctggtcagagacaccgcccgcgatatcagcacggcgttgggactgaaagcacatccataatgtctgtcgcatcccgctctgcggagcgggtttttttgacaaaatttgaaagttggaaaaattttccaataaatagaggtaggaataaaatggcaaaaatgagagccgttgacgcggcaatgtatgtgctggagaaagaaggtatcactaccgccttcggtgttccgggagctgcaatcaatccgttctactcagcgatgcgtaagcacggcggtattcgtcacattctggcgcgtcatgtggaaggtgcttcgcacatggcggaaggttatacccgcgcaacggcagggaatatcggcgtatgtctggggacttccggtcctgcgggcacggacatgatcaccgcgctctattccgcttctgctgattccattcctattctgtgcattaccggccaggcaccgcgcgcccgtctgcataaagaagattttcaggccgtagatattgaagcaattgctaaaccggtcagcaaaatggcggttacagttcgtgaagcggcgctggtgcctcgcgtgctgcaacaggcatttcacctgatgcgttctggtcgtccgggtccggtactggtggatttaccgttcgacgttcaggttgcggaaatcgagtttgatcctgacatgtacgaaccgctgccggtctacaaacctgctgccagccgtatgcagatcgaaaaagctgtagaaatgttaatccaggccgaacgtccggtgattgttgccgggggcggggtaattaatgctgacgcagctgcactgttacaacagtttgctgaactgaccagcgttccggtgatcccaacgctaatgggctggggctgtatcccggacgatcatgaactgatggccgggatggtgggtctgcaaaccgcgcatcgttacggtaacgcaacgctgctggcgtctgacatggtgtttggtatcggtaaccgttttgctaaccgtcataccggctcggtagagaaatacaccgaagggcgcaaaatcgttcatattgatattgagccgacgcaaattggtcgcgtgctgtgtccggatctcggtattgtctctgatgctaaagcggcgctgacactgctggttgaagtggcgcaggagatgcaaaaagcgggtcgtctgccgtgtcgtaaagaatgggtcgccgactgccagcagcgtaaacgcactttgctgcgcaaaacccacttcgacaacgtgccggtgaaaccgcagcgcgtgtatgaagagatgaacaaagcctttggtcgcgatgtttgttatgtcaccaccattggtctgtcacaaatcgctgcggcacaaatgctgcatgtctttaaagaccgccactggatcaactgtggtcaggctggtccgttaggctggacgattccggctgcgctaggggtttgtgccgctgatccgaaacgcaatgtggtggcgatttctggcgactttgacttccagttcctgattgaagagttagctgttggcgcgcagttcaacattccgtacatccatgtgctggtcaacaacgcttatctggggctgattcgtcagtcacaacgcgcttttgacatggactactgcgtgcaactcgctttcgagaatatcaactccagtgaagtgaatggctacggtgttgaccacgtaaaagtagcggaaggtttaggttgtaaagctattcgggtcttcaaaccggaagatattgcgccagcctttgaacaggcgaaagccttaatggcgcaatatcgggtaccggtagtcgtggaagttattctcgagcgtgtgaccaatatttcgatgggcagcgaactggataacgtcatggaatttgaagatatcgccgataacgcagcggacgcaccgactgaaacctgcttcatgcactatgaataagggagataaataatgttacgtttctctgctaatttatcgatgttatttggagaatatgattttctcgcccgttttgagaaagctgcgcagtgtggttttcgcggcgttgaatttatgtttccttatgactacgacattgaagaattaaaacatgtgctggcgagtaataaactcgaacatacgctgcacaatttaccggcgggtgactgggcggcgggggagcgcggtattgcctgtattcctggccgtgaagaagagtttcgggatggcgtagcagcagcgattcgttatgcccgtgcgctgggtaataaaaaaattaactgtctggtcggtaaaacgccggctggtttcagcagtgaacagattcacgcaacgcttgtagaaaacctgcgttatgccgcgaatatgctgatgaaagaagatattttattactgattgaacctattaaccattttgatattcctggtttccatctcaccggaactcggcaggcgctgaaattgattgatgatgttggttgctgcaatttgaaaattcagtatgacatttatcatatgcagcggatggaaggtgaattaaccaacaccatgactcagtgggctgataaaattggtcacctgcaaattgccgataatccgcatcgcggcgaaccgggaaccggagaaattaattatgattatctctttaaggtaatcgaaaattctgactacaacggttgggttgggtgtgaatataaaccccaaaccaccacggaagccggtttacgctggatggatccgtaccgttaaaacgtaacgctattcagacaatgcttttttaggccgctaagttggcaggggatcgtgttgtctgaattcaggaaaagcgaaatttaaaagaggttaattatgaaactgggatttattggcttaggcattatgggtacaccgatggccattaatctggcgcgtgccggtcatcaattacatgtcacgaccattggaccggttgctgatgaattactgtcactgggtgccgtcagtgttgaaactgctcgccaggtaacggaagcatcggacatcatttttattatggtgccggacacacctcaggttgaagaagttctgttcggtgaaaatggttgtaccaaagcctcgctgaagggcaaaaccattgttgatatgagctccatttccccgattgaaactaagcgtttcgctcgtcaggtgaatgaactgggcggcgattatctcgatgcgccagtctccggcggtgaaatcggtgcgcgtgaagggacgttgtcgattatggttggcggtgatgaagcggtatttgaacgtgttaaaccgctgtttgaactgctcggtaaaaatatcaccctcgtgggcggtaacggcgatggtcaaacctgcaaagtggcaaatcagattatcgtggcgctcaatattgaagcggtttctgaagccctgctatttgcttcaaaagccggtgcggacccggtacgtgtgcgccaggcgctgatgggcggctttgcttcctcacgtattctggaagttcatggcgagcgtatgattaaacgcacctttaatccgggcttcaaaatcgctctgcaccagaaagatctcaacctggcactgcaaagtgcgaaagcacttgcgctgaacctgccaaacactgcgacctgccaggagttatttaatacctgtgcggcaaacggtggcagccagttggatcactctgcgttagtgcaggcgctggaattaatggctaaccataaactggcctgatacccgcaataaaaatggccgatatcagaaaatgaatcggccagcaatattaaaaaagaaagcagccaaagatgttgcttcagtattaaaaataatatttttattttatttgttcctcatagctagattaaaacaacgttattcgatacgtgaaattaagagggatttatggaacatcagagaaaactattccagcaacgcggctatagcgaagatctattgccgaaaacgcaaagccagcggacctggaaaacatttaactattttaccttatggatgggttcggttcataacgttcccaattatgtgatggtcggcggcttttttattctcggcttgtctacctttagtattatgctggcaattatcctcagcgcctttttcattgccgcggtaatggtattaaacggtgctgcgggcagtaaatacggtgtgccttttgccatgatcctgcgtgcttcttacggtgtacgtggtgcactgtttcccggattattaaggggcggaattgccgccatcatgtggtttggtttgcaatgttacgcggggtcactggcctgcttgattctgattggcaaaatctggccgggatttttaactctcggtggtgatttcactctgttaggcctttctctaccgggcttaattactttcttaatcttctggctggtcaacgttggtataggttttggcggtggcaaagttttaaataaattcactgccattcttaacccgtgcatctatatcgttttcggcggtatggcgatttgggcgatttcactggtcgggatcggtccaatctttgactacattccgagcggtattcagaaagcagaaaacggtggcttcctgttcctggtggtgattaacgcggtagttgcggtctgggcggcaccggcggtgagcgcatccgactttacgcaaaacgcccactcgtttcgtgagcaggcgctggggcaaacgctgggtttagttgtggcctatattctgtttgcggtcgccggggtatgtattattgccggagccagtattcactacggcgctgatacctggaacgtgctggatattgttcagcgttgggacagcctgttcgcctcgttctttgcggtactggttattctgatgacaactatctccactaacgcgaccggtaatattattccagccggttatcagattgccgccattgcaccgacaaaactgacctataaaaacggcgtactgattgccagtattatcagcttgctgatctgcccgtggaaattaatggaaaatcaggacagcatttatcttttcctcgatattatcggcggaatgcttggtccggtaattggtgtcatgatggcgcattattttgtggtgatgcgcggacaaattaatcttgatgaactgtataccgcacctggcgattataaatattacgataacggttttaacctcactgcgttttcagtaactctggtggccgttattttatctcttggcggtaagtttattcactttatggaaccgttatcgcgtgtttcatggtttgtcggcgtcatcgtcgcctttgcggcctacgccttattaaagaaacgtacaacagcagaaaaaacaggagagcaaaaaaccataggttaattaatcccgatattgaacattgagttaaaaaccaatctgtattttacaaggagtttgttatgtcttttgatttaatcattaaaaacggcaccgttattttagaaaacgaagctcgcgttgtagatatcgccgttaaaggcggaaaaattgctgctatcggtcaggatctgggcgatgcaaaagaagttatggatgcgtctggtctggtggtttcgccgggcatggttgatgcgcacacccatatttctgaaccgggtcgtagccactgggaaggttatgaaaccggtactcgcgcagcggcaaaaggtggtatcaccaccatgatcgaaatgccgctcaaccagctgcctgcaacggttgaccgcgcttcaattgaactgaagttcgatgccgctaaaggcaagctgactattgatgcggcacaactcggtggcctggtgtcttacaacatcgaccgtctgcatgagctggatgaagtgggcgttgtcggcttcaaatgcttcgttgcgacctgtggcgatcgcggtatcgacaacgacttccgtgatgtaaacgactggcagttcttcaaaggtgcgcagaagctgggcgaactgggtcagccggtgctggtgcactgcgaaaacgcgctgatttgtgacgaactgggcgaagaagcgaagcgtgaaggtcgcgtaaccgctcatgactatgtggcttcgcgtccggtatttaccgaagtggaagcaattcgccgcgtactgtatctggcgaaagttgctggttgccgtctgcacgtttgccacgtcagcagcccggaaggtgttgaggaagtgactcgtgcacgtcaggaaggtcaggacgttacttgtgaatcctgcccgcattactttgtactggataccgatcagttcgaagaaatcggtactctggcgaagtgttcaccgccgatccgcgatctggaaaaccagaaaggcatgtgggaaaaactgtttaacggtgaaatcgactgcctggtttccgaccactctccatgcccgccggaaatgaaagccggtaacatcatgaaagcatggggcggtatcgccggtctgcaaagctgcatggacgtgatgttcgatgaagcggtacagaaacgcggtatgtctctgccaatgttcggcaaattaatggcgactaacgcagcagatattttcggtctgcagcaaaaaggccgtatcgccccaggaaaagatgccgacttcgtcttcattcagccgaatagcagctatgttcttaccaatgacgatctggaatatcgccacaaagtcagcccgtatgttggccgtaccattggcgcgcgtatcacgaaaaccatcttacgtggtgatgtgatttacgacattgaacagggcttccctgttgcgccgaaaggtcaatttatccttaaacatcagcagtaatctggcccctgcaatgcccgtccttgcggcgggcattctccggttaaggtgtgtttatgttcaattttgcagtcagccgcgaaagcctgttatcaggatttcagtggtttttctttattttttgcaacacggttgtggttcctcctacgctactttctgcttttcagttgccgcaaagtagcctgcttacgctcacgcaatatgcttttcttgctaccgcactggcctgcttcgctcaggcgttttgcggtcatcgtcgcgctattatggaagggccaggtggcctgtggtggggaaccatccttactatcacccttggtgaagcatcgcgcgggacaccgatcaacgatatcgccaccagcctggcagtggggattgcactctccggcgtgctgacgatgttgattggttttagcggattaggccatcgcctggcacggttatttacgccgtcggtgatggtcttgtttatgttgatgctgggcgcgcagctgaccactatctttttcaaaggtatgctcgggctgccgtttggcatagccgacccgaattttaaaattcagttaccgccgttcgcgctctcggtggcggtgatgtgcctggtactggcgatgattatcttcctgccgcaacgttttgcccgttatggcctgctggtcggcaccataaccggctggttgttgtggtacttttgctttccttcttcgcactcgctctccggtgagttgcactggcagtggttcccgctcggcagtggcggtgctttgtcgccgggaattattctgacggcggtgattacaggtctggtaaatatcagcaatacctacggtgcgattcggggcacggatgttttttatccgcagcagggcgcagggaatacgcgttatcgtcgtagctttgtggcgaccggatttatgacgctgataaccgtaccgctggcggtaattccattttcaccgtttgtttcatccattggtttattaacccagactggcgattacacgcggcgttcgtttatttatggcagcgttatttgcctgctggtggcgctggttcctgcactcacgcgactgttttgcagtatccctttacccgtgagtagtgcggtcatgctggtttcttatctgcctttactcttttccgcgctggtgtttagccagcaaataacgtttaccgctcgcaatatttatcgactcgcattgccgttatttgtcggcatatttttaatggcattaccgcctgtgtatctgcaagaccttccattaacgcttcgtcctctgctcagtaacggcttattggtcgggattttactggctgttcttatggataaccttattccgtgggaacgcatcgaataatttgttgaaaaaggattgataatgaagattgtcattgcgccagactcttttaaagagagcttaagtgcagaaaaatgttgtcaggcaattaaagccgggttttcgaccctctttcccgatgcgaactatatctgtttgccgatagcggatggcggcgaagggacggtggatgcgatggtcgccgcgacgggcggcaacatcgtgacgcttgaagtctgcgggccgatgggcgaaaaagtgaatgctttttatggccttaccggcgacgggaaaacggcggtgattgagatggcggcagcaagtggcctgatgctggtcgcgcctgaaaagcgtaatccgttgctggcctccagttttggtacgggggagttaattcgtcatgcgctggataacgacattcgccatattattctcggcattggcggcagtgcgacggtcgacggcggtatgggcatggcgcaggcgctcggtgtgcgtttccttgatgccgacggtcaggcgctggcggcaaacggtggtaatttagcgcgcgtggcaagcattgagatggatgaatgcgatccgcgtctggcgaattgccatattgaagtagcatgtgacgttgataacccgctggtaggggcacgcggcgcggcggcggtgtttggcccgcaaaaaggggcaacgccggagatggtcgaagaacttgaacaggggctgcaaaattacgcccgtgttttacaacagcaaactgaaattaatgtctgccagatggcgggcggcggcgctgcgggcggtatgggtattgcggcggcggtatttctcaatgcggatattaaaccgggcattgaaattgtgttgaatgcggtcaatcttgcgcaggcagtgcagggcgcagcactggtgattaccggggaagggcgcatcgactcgcaaacggcaggcggtaaagcgccgctgggtgtggcgtcggtggcgaagcagtttaatgtaccggtgattgggattgctggcgtattgggtgatggcgtggaagtggtgcaccagtacggcattgacgcggtattcagcattttgcctcgtctggcacctttagccgaagtgctcgccagcggtgaaaccaatctcttcaacagcgcgcgaaatattgcctgcgccattaaaataggtcagggaattaaaaactaacccttacctttaaagcggatgcgatttatatcgcataagagtgcagtactcatgccggatgcggcatgagtaccatatccttcctgaaaatcgcgcaaattctatatattgcagagatcatgtaggcctgataagcgaagcgcatcaggcaatgttacaaaaaaagccacggtataaaccgtggcaaaatccaacatagctaaaaataatcaggcgagtggtatgacttaaatctctacgtcgcggttacaatctttcgagtaaatatagctgaacgcttcaccacgccctacaccataaccagcctgtaaagaataagcgcccataaagatgtaatcgccttttttcaccgggatccagttattgtcgaggttataaaccccctgaccggaaagaatataggcaccgtgttcctgaacgtgtgtttcgatataaccgtggctggcacctggtgcaaaagagaggatatgcatgttcatatcaaaacctaactctttgggcagaaaatccagcagaataacatcgtccatgccttcataatgaatgcgttccagttcgctggcattgccagaaaccagccacggtgcatagccttctaccggaacatagcggcgcttatataaaaagatttggctgtcttcggcctgggcgttaacaaacgtcattaaggagcctggcgggcaataaagatagccaccttcgcttaaggcaaatgttttgccttcggctttggcagtgatatttccagagatcacatacaggaacgtttcaatgccttcgccaccgaagccctgttggttgccaccgttttgatgcagtgtgaccagataatcaacaaaagaggcacccagctttggcgtggagaggattgtcgcgtcacaattttcaaagcccggaataatattttttaccagaccatccggggttaacagtgcgaaattaccgtgtttaacaatcgcacggttagccagtaaatcttcgcggtaaccggtgacgttatttaaatatcccatttatgactccttatttctgccaggcaagttgataaagcatgagtgccaacgttttgaccccttcggcaaggtcggtaatattggtgcgttccgccgggttatggctgatcccgttgatgctggggataaaaatcatgcaggttggtacgcgaggcgcgaaaatttgcgcgtcgtgcccggcaccactgtgcatcacccggtaattcagtttttctctttcacacaattctgtcagggtggcgaccagctccttattcatcggcacgggttcttcgtccatccataaatcgatatcaataccaatgtccatttcatcgcaaatcgcccgcatgtcgttttctaactgttgggtgaaatcgcgcagcacggcagcgtcggtatgacgacaatcaatggtgaacgtggttttacccggcaccacatttaccgtattcgggcgcggctctactttgccaaaggtcagaaccagcggatcgcccatccttttcgctttttcgaccgactgatggcaaatgcgactgaaagcgtaaactgtatcacgacgataacccatcggcgtggtgcctgcatggtttgattcgccgttcagcgttaccgtataacgacgctgcccgacaattgcattcaccacgccaattgattgcccattactttccagcacacagccctgttcaatatgcagttcaacaaaggctttaatatcctgacgcggagttagtggggcgttcggaagagtaaatccgcaagccttcatcgcatcgacaaaactatttcctttggcatcacagatattccgcacgtcgtcaggattcgccagcccaaaaatatttttactgccccagaagacatacgggaagcggctgccttcttcttctgccatcgccaccacttcgaccgtacgtagcggcgcgccgtattgcgttttcagccagtcaattgccagccacgccgccagcgcgccgaattgcccgtcaaggttaccgccgttaaccacggtatcgatatgcgaaccgctcagaaccacttcctgtggatattcggtgccattcaggcgaccgtataaattccccacttcatcgaaacgtgtttccagcccgcttgctgccattctttttttaaattgctgctgggtttccagccattccggcgaataaagtaaacgggtcatcccacccgctgggtcagcgccaaaagaggaaagccagggcagcgtttcttctatagcttgacggaaatgtgtaatcataagaaagtcctgtctcaataattattgcgcaaagggatttttcgtttcgtatgacgtgttataaagcgcgtcggaaattaaatactggtaaatatcatcaacaatttcgatgccttcgacggcggctttgcgttgtttaatatcctgatcctgtccgggataataaacctgattaaaaccgggcgcgggggtaatggcatttaattcgcgcatggtctggctaagatgttgacggaataattcgctggaggagaaaaagttcggattaataactatatgtaattgccccaaattacgccctgcgtgtaaatcgtcatacatcgaactaacctgtcgcccgaacggtaagccgagtaagacgcctgagaggacgtcaatcatcatcatcaggccatacccttttggcccggcggcggggagcagagcatgtaccgcgaacggatcggttgttggtacaccgtttttatcgaccgcccaggtatccgggatagacatattacgcgagcgggcgtcgagcacttttccccatgcctgtacggtagtcgccatatcaaaggtaaggatctcgtcgccttctcccggcgcggcaaaggccagggggttagtaccgtagtaaatttccgcgccgccaaacggcaccaccattggatcggactggcacatcgaaatgccaatgaatccggcgcgggctgcctgctgcacaaaataagagattgcgccgctgtgacccatccggctgataccgaccaccgcaacgccattttgctgggcggttttgatggcatgttccatacccattttcgccgcgacctgtccggcggcattgtcggcatgtaaaattgccgagcacggcccggtttcctcaagacgaaactccggttcgcggttggtgccgccttttgaaatgcgttccgcgtagtattccacgcgcaccgcgccatgagagtggatccctctggcatcggcgtaaaccaatacttcagccacggttgcagcgtgctcacgttttaacccagcctggcagagtttattctcaattagctggtggagtgtttcccgactgattttcatctgtcttcctttttaacgacggtgtgaagcatgactgcaattaacatacagggaaaatatctggattatgtgatccagacaggcaaaaaaatatagttagaatttatttgataatccgctcacttttaacctgatttttaaaacaacaacgcttattaaaaaataatgagtaatagcctggtggttatttgaattcttttgttaataattcctgtgtgatattcatcaccttatttactcgttgtcatcgataccgtaatcgccacattaacactgctcgtgcaattgccatgggtgcaatttttaaggagttgttatgatccacgcctttattaaaaaagggtgttttcaggattcggtcagtttaatgattatttcacgaaaactcagcgaatcagaaaatgttgatgatgtttccgtaatgatgggtacgcccgccaataaagcgttattagataccacaggtttctggcatgacgattttaataacgccacgccgaacgatatttgcgtggcaattcgtagcgaagcggcggatgcggggatcgcgcaggcgattatgcagcagcttgaagaggcgctaaaacaactggcgcaggggtcaggcagcagccaggcgttgacgcaggtgcgtcgctgggacagtgcctgtcagaaattacccgatgccaatctggcgctgatttcagtggctggcgagtatgcggcggagctggcaaaccaggcgctggatcgcaacctcaacgtgatgatgttctccgataacgtcacgctggaagatgaaatccaacttaaaacccgcgcgcgggaaaaaggcttgctggtgatggggccggactgcggtacgtcgatgattgccggcacaccgctggcttttgctaacgtgatgccggaaggcaatattggcgtcattggcgcttccggtaccgggattcaggagctgtgttcgcagattgcgctggcaggggagggaattactcacgcgattggccttggcgggcgcgacctcagccgtgaagtgggcggcatcagtgcgctaacagcgctggaaatgctcagtgcagacgagaaaagcgaagtgctggcatttgtttcaaaaccacctgccgaagctgtgcgtctgaaaattgttaatgccatgaaagcaaccggcaaaccgacggtggcgctgtttttaggttataccccggcggtggcccgcgacgagaatgtctggtttgcctcctcgctggatgaggccgcacgcctggcttgcctgctttcacgcgtcacggcgcgacgtaacgcaatagcgcctgtcagcagcggatttatttgcggtttgtataccggcggtacgctggctgccgaagcggcgggattacttgccggacaccttggcgtggaagccgacgatacccatcaacatggcatgatgctggacgccgatagccaccagattattgacctcggcgatgatttctacaccgtcgggcgtccccatccgatgatcgacccaaccttacgcaaccagttaattgccgatctcggcgctaaaccgcaagtgcgcgtgttgctgcttgatgtcgtgattggcttcggtgcgaccgccgatcctgccgcctcgctggtgagcgcctggcaaaaagcctgtgccgcgcgtttagataatcaaccactgtatgccattgccacggtgacaggcactgaacgtgacccgcaatgccgctcgcagcaaatcgccacgctggaagatgcggggattgcggtcgtgagttcgctaccggaagccaccttgctggcggcagcgttaattcatccgctctcgcctgccgcacagcaacacacaccgtcattactggaaaacgtcgccgtgattaacatcggattacgcagctttgcgctggagctacaaagcgccagcaaaccggttgtgcattaccaatggtcgccagtcgccggtggcaataaaaaactggctcgtttattagaacgtttgcaataaggggttcccatgtttacatcagtggcgcaagccaatgctgcggttatcgaacaaattcgtcgcgctcgtccacactggctggatgtgcaaccggcttcttcacttatcagcgaactaaacgaaggcaaaacactgcttcacgccgggccgccaatgcgctggcaggagatgaccggacccatgaaaggggcgtgcgtgggcgcatgtctgttcgaaggttgggcgaaagatgaagcgcaggcgctggcaatactggagcaggggaagtgaacttcattccttgtcaccatgtgaatgccgtcgggccaatgggcggtattacttctgccagtatgccgatgctggtggttgagaacgtgaccgacggcaaccgggcgtactgcaacctcaacgaaggtatcggcaaagtgatgcgttttggcgcttacggcgaagatgtcctgactcgccatcgctggatgcgcgatgtgttaatgccagtattaagcgcggcgctggggcgcatggagcgcggtatcgatctcacggcgatgatggcgcagggcattacgatgggcgatgagttccatcaacgcaatattgcttcctctgcactgttaatgcgtgcgctggccccacaaattgctcgcctcgatcatgataaacagcacatcgccgaagtgatggatttcctcagcgtgaccgatcagttcttcctcaacctcgcgatggcttactgcaaggcggcgatggatgctggcgcgatgatccgcgcaggcagcatcgtcacggcaatgacccgcaacggcaatatgttcgggattcgggtaagcgggctgggcgaacgctggtttactgcgcctgtaaacactccgcaaggtctgtttttcaccggcttctcgcaggagcaggcgaacccggatatgggcgatagcgcgattaccgaaacctttggtatcggaggtgcggcaatgatcgcagcgcctggcgtaacgcgctttgtcggtgcgggtggcatggaagcggcaagagcggtatctgaagagatggcggaaatttaccttgaacgcaatatgcagttgcagatcccaagctgggattttcagggcgcgtgcctggggctggacattcgtcgcgtggtagaaaccggcattacgccactcatcaataccggtatcgcccataaagaggcggggatcgggcagattggcgcaggcaccgtgcgggcaccgctggcgtgctttgaacaggcgctggaagcactggctgaaagcatgggtattggttgaggaacgcgcaatgacgatcatccatcctctgcttgccagtagtagcgcaccgaattatcgccagtcctggcggttagcgggagtgtggcggcgggcgattaacctgatgacggaaagcggcgaactgttaacgttgcatcgtcagggtagtggtttcggccccggaggatgggtgcttcgccgtgcgcaattcgatgcgttatgcggtggattatgcggcaatgaacgaccacaggttgtggctcaagggattcgcctcgggcgtttcacggttaaacagccacagcgttattgtttgctgcgtattacgccgcctgcgcatcctcaaccacttgcagctgcatggatgcaacgcgcggaggaaaccgggcttttcgggccactggcgttggcggcaagcgatccgctgcctgctgagttacgccagtttcgtcactgttttcaggccgcgctcaatggcgttaagaccgactggcggcactggctgggtaaaggccccggattaacgccgagtcatgatgacacgctgagcggaatgctgctggcggcctggtattatggcgctttagatgcgcgctccggtcgtccgttttttgcctgttccgacaatctgcaactcgttaccacagcggtgagcgtcagttatttacgttatgccgcgcaaggatatttcgcctcgccactcctgcactttgttcatgctctgagttgcccgaaacgtaccgctgttgcgattgattcgctgctggcgctggggcatacgtcaggggcagatacgctgctggggttctggcttggccaacaattattacaaggaaaaccatgaaaacactggttgtggctcttgggggcaacgccttactccagcgcggtgaggcgctgacggcagaaaatcaatatcgcaatatcgccagtgctgtacccgcgctggcacgcctggcccgttcttatcggttggcgattgttcacggcaacgggccgcaggtggggctgctggcattgcagaatctggcgtggaaagaggtagaaccgtatccgctggatgtgctggttgcggaaagccaggggatgattggctatatgctggcgcagagtttgagcgcacagccgcagatgccgcccgtgacgacggtgctgacgcgcattgaggtttcgcctgatgatccggcgtttttgcagccagagaaatttattggtccggtttatcagccagaagaacaagaggcactggaagcggcttacggctggcagatgaaacgtgatggtaaatatttgcgccgggtggtggcgtctccgcaaccgcgtaaaattctcgacagcgaagccatcgagttgttgctcaaagaggggcatgtggtgatttgcagtggcggcggcggtgtgcctgtgacggatgacggagcagggagtgaagcagtgattgataaagatctcgccgctgcgttgctcgccgagcagattaatgcagatggactggtgatcctcaccgatgctgatgcggtatatgaaaactggggaacgccgcagcaacgtgccattcgccatgccacaccggatgagttagcgccatttgccaaagccgatggttcgatggggccgaatgtaacggcggtgagtggttatgtcagaagccgtggtaaacccgcgtggattggggcgttatcgcgaattgaagagacgctggcgggcgaagcggggacctgtatttcgctgtagtcgtaggcattagacatttgtgcctgatgcgacgcttgacgcgtcttatcaggcctacaaccggtgccgcatccggcaattggtgcacaatgcctgatgcgatgcttgacgcatcttatcaggcctacaatgggtaccggatcggtaggccggataaggcgtttacgccgcatccggcaagaatagagcaccagttaaccgaacttactctgcgcccaaatcacgccgctggcatattccggcggcagcagcgggattaaggcttccagcgtcgcagtcagacgcgatgtgtcgctgtcggtcaaattcagatgccccactttacgccccggacggacttctttgtcgtaccagtgcagatgcaccagcggcagtttcagccagtcataattcacatcgctaccaatcagattgatcatcaccgacggattattcaccactggttgcggtaacggcagatcggtaatcgcccgcagatgcagctcaaactggctgatgctggcaccgttttgtgtccagtgaccgctgttatgcacacgcggtgccagttcgttgatcaacagaccttgcggggtgacaaaacactccatcgccatcacgcccacatagcccagctcctgcataatcgccgacagcatctcttcggcttgcgcctgctgctgtgcgttggcctgcggaaaagcgacgctggtgcgcaaaataccgtcctgatgcaggttatgcgtcagcggataaaacacggtgctgccatcaaagccgcgcgcgccaaccagcgacacttcaccagagaagttaatgccctgctcgacaatacattcgccgtaacactctgccggtaactgttcggtttcatttgcgcgtaaacgccattgaccgcgaccgtcataaccaccagtgcgacgcttaacaatcgccagctcacctaaacgatcaaacaccgcaggccactcgctgcgttcggcaagtaactgccacggtgcagtcggcaggtggagcttatcgaaaagctgcttctgagtcagacggtcagcaataatcgggaacacatcgcggttcacaaaggccggatggcgcgccagctcgcgggttaatgcggtttccggccagcgttctatctcagcggtaatcacgctttgttgaaaaggcaccgccgccggttcagcgtccagcccgactggccagacagcaatgcctaacggttcgcctgcctgacgcagcatacggcctaactgcccgttaccgaggacgcaaacctgtttcatgccgcacctcgcgggtccgggttttccagcacttcgtcggtctgggctttgcgccagtcattcagacgctggtgcagttctttatcatgagtcgcaagaatttgtgctgccagtaacgccgcgtttgccgcgccagctttaccaatcgccagcgtacccaccggaatgccgcgcggcatttgtacgatggagtagaggctatcgacaccgctcagtgcggcgctctgtactggcacgcccagcaccggcaccagcgttttggcggcaatcatgcctggcagatgcgctgcgccgcctgcgcccgcaataatcacctgataaccgttctcttcggcgctttcggcgaagctgaacagtttatcgggggtgcggtgagcagaaaccacttcaacgtggtgcgggacattcaggatttcgaagatttcggcggcgaactgcatggtagcccagtcgcttttggaccccatcacgatggcgacacgcgccggattattgcgggaagacatgcgtcttaaaactcctgtggtgcacaactctcggctttagagggcacagagaatagcacggaaagagagcaaggaaaacggttgcgtggctgtgaaatcagcaaagttgcgggttttttaaaacggaaaatgaatcagctcaacgtcatccgccgtgactttcaccattgaaccttccgtatgccaggcacccagtaccacgcgaaaagcaggttgctgattggcgataagttcatgcaccgccgggcgatgggtatgcccgtggatcagccattgcacctgatgtttttccatcgcactgaccaccgcgttttggttaacgtccatgatcgccagcgatttactgctgttggcttctttgctgttcgcgcgcattcgcgcggcaatgcgtttgcgcacaaacaacggcagggcgaggaatagcgtctgcagccagggtttgtggaccttggcgcgaaaagcctgataacccgcgtcatcggtgcacagcgtgtcgccatgcataatcaacacccggcgaccataaagttcgagcaccttttcttccggcaataacgtcatgccactttcacgggcaaagcgtttgccgagcagaaaatcacggttgccatgaatgaaataacagggaacgccggaatcggacaccgctttgatcgccgccgccatcttgcgatggagtgggttgggatcgtcgtcgccaatccatgcttcaaacagatcgccaagaatatacagcgcgtcggccttgcgggcttcccccgctaaaaaacgcagaaaaccggcggtgatcgccggttcttccacgcagagatgaagatctgcaataaagagtgtcgccacgattactcgctaacggtcacgctttcaatgataacgtcttcttttggcacgtcctggtgcataccgctacgaccggttgcaacacctttgattttgtctaccacgtccatgccgtcaaccacttcagcaaacacgcagtagccccaaccttgcaggctttcgccagagaagttcaggaagtcgttatcaaccacgttgatgaagaactgtgcagttgcagagtgcggagcctgagtacgtgccattgccagcgtaccacgggtatttttcaggccgttgttggcttcgtttttgatcggttctttggtggctttttgtttcatgcccggttcaaaaccgccgccctgaatcataaagccgttgataacacggtggaaaatggtgttgttgtaaaaaccttcgcggcagtagtccaggaagtttttaactgtttcaggtgctttatcgtcaaaagttttgatgacaatatcgccgtgattggtgtggaaagtaaccatttttgcatcctgttccgtttgattggtgcttcaacccagttcgggtcatatatagggtggtgttatagcataaccgcacgatcggatcatcacgcaatgtatgctgattcgcgcgggaaatatgggtattatacgcaactcaattacccacacatgtctaaacggaatcttcgatgctaaaaatcttcaatactctgacacgccaaaaagaggaatttaagcctattcacgccggggaagtcggcatgtacgtgtgtggaatcaccgtttacgatctctgtcatatcggtcacgggcgtacctttgttgcttttgacgtggttgcgcgctatctgcgtttcctcggctataaactgaagtatgtgcgcaacattaccgatatcgacgacaaaatcatcaaacgcgccaatgaaaatggcgaaagctttgtggcgatggtggatcgcatgatcgccgaaatgcacaaagattttgatgctttgaacattctgcgcccggatatggagccgcgcgcgacgcaccatatcgcagaaattattgaactcactgaacaactgatcgccaaaggtcacgcttatgtggcggacaacggcgacgtgatgttcgacgtcccgaccgatccaacttatggcgtgctgtcgcgtcaggatctcgaccagctgcaggcaggcgcgcgcgttgacgtggtcgacgacaaacgcaacccaatggacttcgttctgtggaagatgtcgaaagagggcgaaccgagctggccgtctccgtggggcgcgggtcgtcctggctggcacattgaatgttcggcaatgaactgcaagcagctgggtaaccactttgatatccacggcggcggttcagacctgatgttcccgcaccacgaaaacgaaatcgcgcagtccacctgtgcccatgatggtcagtatgtgaactactggatgcactcggggatggtgatggttgaccgcgagaagatgtccaaatcgctgggtaacttctttaccgtgcgcgatgtgctgaaatactacgacgcggaaaccgtgcgttacttcctgatgtcgggccactatcgcagccagttgaactacagcgaagagaacctgaagcaggcgcgtgcggcgctggagcgtctctacactgcgctgcgcggcacagataaaaccgttgcgcctgccggtggcgaagcgtttgaagcgcgctttattgaagcgatggacgacgatttcaacaccccggaagcctattccgtactgtttgatatggcgcgtgaagtaaaccgtctgaaagcagaagatatggcagcggcgaatgcaatggcatctcacctgcgtaaactttccgctgtattgggcctgctggagcaagaaccggaagcgttcctgcaaagcggcgcgcaggcagacgacagcgaagtggctgagattgaagcgttaattcaacagcgtctggatgcccgtaaagcgaaagactgggcggcggcggatgcggcgcgtgatcgtcttaacgagatggggatcgtgctggaagatggcccgcaagggaccacctggcgtcgtaagtaattgcgctattgccggatgcgagttttcgcatccggttatcgtctgcgccaccacaacattcccatcagtagcatccccggcaaccacacccacatcaattcagaaataatcacctgatgcccgtacggcgtggtgtaacgagacaatgcaaacggcgcgacttttatcacctgccagggagcgaaaaagcgttcatctgaccacggccacagccagccaacgcctttaccgccagtggttaccgaatccagcaagctgtgcgatagcaacgagacggttaaaaacagccagcagcgaatcagcccagccctgaaccatcggcgtccaataaacacacataacagcgggacaacaaacgcaaacaccagcgaatgggtaaacccgcgatgaccaaaaacattgccgtaagcaacgccaaatttaaacgacaatacgtcggcgtcgggcagcatcgccaggatgattccggcaaataacagacgcggagggatgactttcgaacccaaccctaaaccaatgcataggggaacggcggcgtgcgtaataacggttggcatgatggtcgcttcggcaaaatgtcgatgctatcagcatggatgaacggggcgtagagggcaaaagtctgaaaagagaaccggcctgttgatacaggccgggaaagggatcaggcaacaacctgtacgctgtgacctgcaaaactcactgtctgaccggcgacgattttgcagcgtttgcgcgtttcaaccgcaccgtcgactttcacctggccttcggcaatcgcgattttcgcctgcgcgccgctttcgctccagccttccagtttcagcaagtcgcacagctcaacgtgcggatgtttacctaaagaaaatgtcgccatgttactcatcctgtggatcatgatattcaacgcacgcctgtagcgtgttttcaatcagcgtggcaaccgtcatcgggccaacgccgccgggaacaggcgtaatgtatgaggcgcgtttagccgcgtcttcaaacacgacgtcgcccacaactttgccattttccagacggttgatgccgacatcaatcacaattgcgccttctttgatccagtcaccgggaataaagcctggcttgccaacggcaacgatcaatagatcggcattttctacgtgatgacgcagatttttagtgaagcggtgagtcactgtagtggtgcaacctgccagcagcagttccatgctcatcgggcggccaacgatattcgatgcgccaatcaccacggcgttgaggccgaaggtatcaatgttgtaacgctcaagcagcgtgacgataccgcgcggggtgcagggacgcagacgcggcgcgcgctggcacagacgaccgacgttgtaaggatggaaaccgtccacgtctttgtccggatgaatacgttccagcactttgacgttatcaatacccgccggtaacggcagttgaaccagaatgccatcgatggtgttgtcggcattcagcgtatcgataagctccagcagctccgcttcgctggtggtttccgggaggtcataagagcgggagacgaacccgacttcttcacaagccttgcgtttgcttgcgacataaatttgcgatgcagggttactacccaccagcacaacggccagtcctggtgcccgcagtccggctgcaatacgcgcctgaactttttgagcaacttcagagcgcacctgctgcgcaatcgttttaccgtcaataatctttgctgccatcagagagaggattccatctgttacgtagatcgaaggggatgcgcctattttgtcagaagcggggcgcgctgtcaggtttcgtttcagatttatcgcgtgaagcgacctcttgcgaaggtgaggcgcaccgtcgctgagactgaaagcttcatttttcgtccatgatggcgttgtaaatctggaactgatttatttccttgtctaaggattaagataatttaagaaatacctgacaatataaaaagaattttcagcctggtaatttaccgcttcaggtctatatttgtgttgaatatattttgcgcggaagtattcatctaacggggctctctattttttagaatagagtgcatattttcaattaagacattcttagaggataaaaaggaatttactactatcagtgtcttaaataaagtaatcggttatatacggatgtggagtcgataaatgagattgaaggaatatatatgaaattaagatttatttcgtctgcgctggctgccgcactattcgccgctacgggtagttatgctgccgttgtagatggcggtacaattcactttgaaggcgaactggtgaatgctgcctgttcagtgaatactgactcggcagaccaggttgtcacactcggtcaatatcgtaccgatattttcaatgctgttggtaatacctctgcattaattccattcaccattcagttgaacgactgcgatcctgttgttgccgctaatgctgccgttgcattttctggtcaggctgatgcaatcaatgataatttattggccattgcatccagtaccaatacaacaacagcaacgggtgtcggtattgaaatacttgataatacatccgcaattctcaaacctgatgggaatagcttctcaaccaaccagaacttgatccccgggaccaacgttcttcatttttctgcacgttataaaggcaccggtacaagtgcatcagcagggcaagcaaatgctgacgcgacttttattatgagatatgaataatcaaaaccacgttgttttgaattatatatcacgtcttataacaaagtaatgtaccggttgtctgaagcggtatggtggcaatgtaaatcgaaatcatgttcactttgtatcatgccgctttattaaatgaaaagggaatgatgtgttgtaagaaaccaaagcaatcatttctttatattccttatttttgccgtcaggaatacacaaggcgtattaactatgatgactaaaataaagttattgatgctcattatattttatttaatcatttcggccagcgcccatgctgccggagggatcgcattaggtgccacgcgtattatttatcccgctgatgctaaacagactgcggtatggattagaaatagccataccaatgagcgctttctggtcaattcgtggattgaaaacagcagcggtgtaaaagaaaagtcattcatcattacaccgccactgtttgttagtgaacccaaaagcgaaaatactttgcgtattatttacaccggtccaccgctggcagcagatcgtgagtctctgttctggatgaatgttaagacgatcccttcggtagataaaaatgcattgaacggcaggaatgttttgcaactggcgattttatcgcgcatgaaattatttctccgtccaattcaattacaagaattacccgcagaagcgccggacacactcaagttttcgcgatccggtaactatatcaatgttcataatccatcacctttttatgtcaccctggttaacttacaagtgggcagccaaaagttggggaatgctatggctgcacccagagttaattcacaaattcccttaccctcaggagtgcagggaaagctgaaatttcagaccgttaatgattatggttcagtaactccggtcagagaagtgaacttaaactaaccgaatcatctgacaatatcagagctaattatgaaaatacccactactacggatattccgcagaggtatacctggtgtctggccggaatttgttattcatctcttgccattttaccctcctttttaagctatgcggaaagttatttcaacccggcatttttattagagaatggcacatccgttgctgatttatcgcgctttgagagaggtaatcatcaacctgcgggcgtgtatcgggtggatctctggcgtaatgatgagttcattggttcgcaggatatcgtatttgaatcgacaacagaaaatacaggtgataaatcaggtgggttaatgccctgttttaaccaggtacttcttgaacgaattggccttaatagcagtgcatttcccgagttagcccagcagcaaaacaataaatgcatcaatttactgaaagctgtacctgatgccacaattaactttgattttgcagcgatgcgcctgaacatcactattcctcagatagcgttgttgagtagcgctcacggttacattccgcctgaagagtgggatgaaggtattcctgctttactcctgaattataatttcaccggtaacagaggtaatggtaacgatagctatttttttagtgagctcagcgggattaatattggcccgtggcgtttacgcaacaatggttcctggaactattttcgcggaaatggatatcattcagaacagtggaataatattggcacctgggtacagcgcgccattattccgctgaaaagtgaactggtaatgggagacggcaatacaggaagtgatattttcgatggcgttggatttcgtggtgtacggctttattcttctgataatatgtatcctgatagccagcaagggtttgccccaacggtacgtgggattgcccgtacggcggcccagctaacgattcggcaaaatggttttattatctatcaaagctatgtttcccccggcgcttttgaaattacagatttgcacccgacatcttcaaatggcgatctggacgtcaccatcgacgagcgcgatggcaatcagcagaattacacaattccgtattcaacagtgccaattttacaacgcgaagggcgtttcaaatttgacctgacggcgggcgattttcgtagcggtaatagtcagcaatcatcgcctttcttttttcagggtacggcactcggcggtttaccacaggaatttactgcctacggcgggacgcaattatctgccaattacaccgcctttttattagggctggggcgcaatctcgggaactggggcgcagtgtcgctggatgtaacgcatgcgcgcagtcagttagccgacgccagtcgtcatgagggggattctattcgcttcctctatgcgaaatcgatgaacaccttcggcaccaattttcagttaatgggttaccgctattcgacacaaggtttttatacccttgatgatgttgcgtatcgtcgaatggaggggtacgaatatgattacgacggtgagcatcgcgatgaaccgataatcgtgaattaccacaatttacgctttagccgtaaagaccgtttgcagttaaatgtttcacaatcacttaatgactttggctcgctttatatttctggtacccatcaaaaatactggaatacttcggattcagatacgtggtatcaggtggggtataccagcagctgggttggcatcagttattcgctctcattttcgtggaatgaatctgtagggatccccgataacgaacgtattgtcggacttaatgtttcagtgcctttcaatgttttgaccaaacgtcgctacacccgggaaaatgcgctcgaccgcgcttatgcctcctttaacgccaaccgtaacagcaacgggcaaaatagctggctggcaggtgtaggtgggaccttactggaaggccacaacctgagttatcacgtaagccagggtgatacctcgaataatgggtacacgggcagcgccacggcaaactggcaggccgcttacggtacgctggggggcgggtataactacgaccgcgatcaacatgacgttaactggcagctgtctggcggtgtggtcgggcatgaaaatggcataacgctgagccagcctttaggggataccaatgttttgattaaagcgcctggcgcaggcggtgtacgcattgaaaatcaaactggcattttaaccgactggcgcggctatgcggtgatgctgtatgccacggtttatcggtataaccgtatcgcgcttgataccaatacgatggggaattccatcgatgttgaaaaaaatattagcagcgttgtgccgacgcaaggcgcgttggttcgtgccaattttgatacccgcataggcgtgcgggcgctcattaccgttacccagggcggaaaaccggtgccgtttggatcactggtacgggaaaacagtaccggaataaccagtatggtgggtgatgacgggcaagtttatttaagtggtgcgccattgtctggtgaattactggttcagtggggagacggcgcgaactcacgctgcattgcgcactatgtattgccgaagcaaagcttacagcaagccgtcactgttatttcggcagtttgcacacatcctggctcataaaggaaattatcaataagataatctgcagattattattggcgatggcatgtttgtgtctggcaaacatatcctgggctactgtttgtgcaaatagtactggcgtagcagaagatgaacactatgatctctcaaatatctttaatagcaccaataaccagccagggcagattgttgttttaccggaaaaatccggctgggtaggtgtctcagcaatttgtccacccggtacgctggtgaattatacataccgtagttatgtcaccaactttattgttcaggaaactatcgataattataaatatatgcaattacatgattatctattaggtgcgatgagtctggttgatagtgtgatggatattcagttccccccgcaaaattatattcggatgggaacagatcctaacgtttcgcaaaaccttccattcggggtgatggattctcgtttaatatttcgtttaaaggttattcgtccctttattaacatggtggagatccccagacaggtgatgtttaccgtgtatgtgacatcaacgccttacgatccgttggttacacctgtttataccattagttttggtggccgggttgaagtaccgcaaaactgcgaattaaatgccgggcagattgttgaatttgattttggtgatatcggcgcatcgttatttagtgcggcagggccgggtaatcgacctgctggtgtcatgccgcaaaccaagagcattgcggtcaaatgtacgaatgttgctgcgcaggcttatttaacaatgcgtctggaagccagtgccgtttctggtcaggcgatggtgtcggacaatcaggatttaggttttattgtcgccgatcagaacgatacgccgatcacgcctaacgatctcaatagcgttattcctttccgtctggatgcagctgcggcagccaatgtcacacttcgcgcctggcctatcagtattaccggtcaaaaaccgaccgaagggccgtttagcgcgctggggtatttacgcgtcgattatcaatgaggtacggagaatgagaagagtactctttagctgtttctgcgggctactgtggagttccagtggatgggcagttgaccctttaggaacgattaatatcaatttgcacggtaacgttgttgatttctcctgtaccgtaaacacagcggatattgataagacggtagatttaggcagatggcctacgacacaactactgaacgctggcgataccacggcactcgtcccttttagcctgcggctggagggatgtcctccgggttcagttgcgattttatttacgggaacgccggcatccgataccaacctgctggctctggatgatcccgcaatggcacaaaccgtcgccatcgaattacgtaatagcgatcgctcccggctcgcactgggggaggcgagcccgactgaggaagtagatgcaaatggcaatgtcacactaaacttttttgccaattatcgagcgttagccagcggtgttcggccaggtgtggcgaaagcggatgcgatatttatgatcaattataattaatattatattaattcgtataatttggcgtagtcgataagctctacaattgaatgcaaacctagcttgccataaatattagatttatgcgcactaactgttttattgctaagtaataacttatcggcaatttctttattagataatccgctaaccagataacgtaatatggtcacttcacgattagatagcacagtgaccgttgaactattcgtactacatttattgctttttatatagttaagcgtttcgctgggaaaaaacgtgtatccggagaggatcatctgaacggcatgaaaaatatcattctgatcattgcatttactgacaaaaccgttagcaccagcttgtatcgctctgccagcataaaagcattctgatttcgatgataaaaataacactttcactgtgctctggatttgtttgatccttttcaggaaggtaaaaccgtctgttccgggcaagtctatatccataatgattaaatcaacaggacgggttcggagataatcgatggttatgcgataatcatccgttttcaggacaatctgcaattcactgtttttttgcaacagaacttcaatagacattctgatgataggatgagtatccataatgatcaccgacgttggtttcatagttaccagtctcataggagcggacaattttccgttaggtcgggaaattgtactttgatacatgaaaatacgggttttcttgattcagacgcgcagcggtgtgcgtttgtttgccgctatagcgaaataaatcagaaaatcagacgcggtcgttcacttgttcagcaaccagatcaaaagccattgactcagcaagggttgaccgtataattcacgcgattacaccgcattgcggtatcaacgcgcccttagctcagttggatagagcaacgaccttctaagtcgtgggccgcaggttcgaatcctgcagggcgcgccattacaattcaatcagttacgccttctttatatcctccataatttcagagtgggacatatttgggacattatcaccaaaaatgtcgtctattttcctcgcatgctctgtcaaatgattaggcgcaaggtgagcatacctacgaaccatttctatggactcccatccgcccatttcctgaagcactgataatgggacgcctgactgaatcagccagcttgcccaggtgtgtctgaggtcatggaaacggaaatcttcaattcctgcacgacgacaagctgatagccatgatgtcttgctgtcgatgcgcatcttcctgaccgcaggcgttgatgttccatctgctcgcttagccgccttggtatgtacaaacacccatttgtgatgcttgcctatttgatcacgcaacactttacaggcggtatcgttcagcgccacaccaatggcgcggtttgatttgctctcttctggattcacccaggcaactcgtcgctgcatgtcgatttgttgccattccagatttatgatgttcgactttctcagaccagttgccagcgcaaacttgacgacagatttcagtggttcggggcactcatcaataaggcgttttgcttcctccttttccagccatctgactcgcttgtttctgaccgctggtatcttgatgacaggcgctttttccagccacttccagtcgcgttctgcagcacggagaatggcctttatcatggcaagatgctttgcctttgtctgagttgatactggctttggttcataaacaggcagttctttacctttcctgatggcggcctgaactttctgtttccatatttctttcgtctttctgttatgcattctgcttacagcagagtaaatctttgcctccgagatatctttaagccttataccctcaaaatgttcaagccagaactcaatccggcttttatctgaatcgagagattttttatcagctttttcctcaagccatcttaggcaggcctcttcaaaagtgacatcaggtaaatcccctagcttttctactcgccagagttctgcttttcgcttgtcgtgcaactcctgagcttgccgtttgtcctttgtgccaagagattccttaattcgtttcccgcccgggagcgaatacgaggcataccatatttcatttctgcggaagagtgacattttctttcctctgttatgccatcacccgcgctcacctggacagtatgcagcggagactgaagcgccgcaatgcaggcttgccgtgttgtgaggtacccggatattatcgtgaggatgcgtcatcgccattgctccccaaatacaaaaccaatttcagccagtgcctcgtccattttttcgatgaactccggcaccatctcgtcaaaactcgccatgtacttttcattccgctcaatcacgacataatgcaggccttcacgcttcatgcgcgggtcatagttggcaaagtaccaggcatcttttcgcgtcacccacatgctgtactgcacctgggccatgtaagccgattttattgcctcgaaaccaccgagccggaatttcatgaaatcccgggaggtacgagtattgccggaagcgtggcctgtatccggatgcagagtcttatccgtggaaatcgaacgcgcattactggttggttaccaacttgtaccagaacatgcgggccaatgcgctggctgacgcggaattacggcgcaaggctgccgatgaactgacctgtatgacagcgcgaattaaccgtggtgagacgatacctgaaccagtaaaacaacttcctgttatgggcggtagacctctaaatcgtgcacaggctctggcgaagatcgcagaaattaaagctaagttcggactgaaaggagcaagtgtatgacgggcaaagaggcaattattcattacctggggacgcataagagcttctgtgcacaggacgttgccgcggtaacaggcgcaaccgtaatctgatcttacccagcaatagtggacacgcggctaagtgagtaaactctcagtcagaggtgactcacatgacaaaaacagtatcaaccagtaaaaaaccccgtaaacagcattcgcctgaatttcgcagtgaagccctgaagcttgctgaacgcatcggtgttactgccgcagcccgtgaactcagcctgtatgaatcacaactctacaactggcgcagtaaacagcaaaatcagcagacgtcttctgaacgtgaactggagatgtctaccgagattgcacgtctcaaacgccagctggcagaacgggatgaagagctggctatcctccaaaaggccgcgacatacttcgcgaagcgcctgaaatgaagtatgtctttattgaaaaacatcaggctgagttcagcatcaaagcaatgtgccgcgtgctccgggtggcccgcagcggctggtatacgtggtgtcagcggcggacaaggataagcacgcgtcagcagttccgccaacactgcgacagcgttgtcctcgcggcttttacccggtcaaaacagcgttacggtgccccacgcctgacggatgaactgcgtgctcagggttacccctttaacgtaaaaaccgtggcggcaagcctgcgccgtcagggactgagggcaaaggcctcccggaagttcagcccggtcagctaccgcgcacacggcctgcctgtgtcagaaaatctgttggagcaggatttttacgccagtggcccgaaccagaagtgggcaggagacatcacgtacttacgtacagatgaaggctggctgtatctggcagtggtcattgacctgtggtcacgtgccgttattggctggtcaatgtcgccacgcatgacggcgcaactggcctgcgatgccctgcagatggcgctgtggcggcgtaagaggccccggaacgttatcgttcacacggaccgtggaggccagtactgttcagcagattatcaggcgcaactgaagcggcataatctgcgtggaagtatgagcgcaaaaggttgctgctacgataatgcctgcgtggaaagcttctttcattcgctgaaagtggaatgtatccatggagaacactttatcagccgggaaataatgcgggcaacggtgtttaattatatcgaatgtgattacaatcggtggcggcggcacagttggtgtggcggcctcagtccggaacaatttgaaaacaagaacctcgcttaggcctgtgtccatattacgtgggtaggatcaaccagcataaatcaggctgcggctaaaatggcgcgggcaggaatcctggtcgttgatggtaaggtctggcgaacggtgtattaccggttcgctaccagagaagaatgggaaggaaaggtgagcacgaatctgatttttaaggagtgtcgccagagtgccgcgatgaaacgggtattgagggtatataaaagaacatcaatgggaacacaatgatgaaacaggtgagttgagttcaaactgtagtacaattctctccagtttgaacaggaaagaatatgctatgaacccttatatttatcttggtggtgcaatacttgcagaggtcattggtacaaccttaatgaagttttcagaaggttttacacggttatggccatctgttggtacaattatttgttattgtgcatcattctggttattagctcagacgctggcttatattcctacagggattgcttatgctatctggtcaggagtcggtattgtcctgattagcttactgtcatggggatttttcggccaacggctggacctgccagccattataggcatgatgttgatttgtgccggtgtgttgattattaatttattgtcacgaagcacaccacattaaaataatttgtttctaaacgactaaaatatggaggctcttatatttatatgagcctcgttttatgctttttgttaatgtctttattttttatgtattcttttgtgctttcaagattatggcgtaagaaaattgcaatacgattattgttgtatattcaagataatgtgaccttaattgtctttttaaataaaaaataaacaaaaattatatcccaccactaaggtttataaaagcatacgttagcaggtgtcaccatgaaaaaagccatagcatatatgcgattttcatcaccaggtcagatgtctggcgactcattaaaccgacagagaagacttattgctgaatggttaaaggtaaatagtgattattatcttgataccataacatatgaagatttaggattaagtgcattcaaaggaaagcatgcacaatcaggagctttttcggaatttttagatgctatagagcatggttatatattgccaggaactacattgttagttgaaagtctggacagactttcaagagaaaaagtcggtgaagcgattgaacgtctgaaattgattttgaatcacggtattgatgttataactctttgcgacaatacagtctataatattgactctttgaatgagccatattcattaataaaagccatacttatagcacaaagggcaaatgaagaaagcgagataaagtcaagtcgggttaaattatcatggaagaaaaaacggcaggatgcactggaatcaggtacgattatgacggcgtcttgtccgagatggctctccttagatgacaaaagaacggcttttgttccagaccccgacagggtgaaaactattgagctaatttttaaactcaggatggaaaggcgctcattgaatgcaatagccaagtatttaaatgatcatgctgtaaagaatttctcaggaaaagaaagtgcatggggaccttctgtaattgaaaaattattagcgaataaagctctgataggtatttgcgtaccttcatatcgtgcaagagggaaagggataagtgaaatcgctggctattatcccagagtcatatcagatgatttgttttacgctgtacaggaaattcggttggcaccttttggtattagcaatagtagcaagaatcctatgctaataaatctacttcgaacagttatgaagtgtgaggcttgtggtaataccatgattgttcatgcggtatctggaagtttgcatggctattatgtttgtccgatgagaagattacatcgatgtgacaggccatcaataaaaagagatttggttgattataatatcattaatgaattgctttttaattgtagcaaaattcaaccagttgaaaacaagaaagatgctaatgaaactttagagttaaaaattattgagcttcagatgaaaattaataatttaatcgttgcattgtctgtcgcgcctgaagttaccgctatagcagagaaaataagactattagataaggaattacgaagggcttcggtatcattgaaaactttgaagagtaaaggtgtaaattcattcagtgatttttatgctattgacttaaccagtaaaaatggacgagagttatgccgtacacttgcctataaaacattcgaaaaaatcataattaatacggataataaaacctgtgatatctattttatgaatggcattgtttttaaacactatcctttaatgaaagtaatatccgcccagcaggcgataagtgctctcaaatatatggttgatggtgagatttatttctaaataatgatctcggattttaagttatgctatggtgataaagtgcaagacagaattaattatctttgacgaaacttaatgggtaattactttgtttgctcccacaagcgagttttgtacggctgtattggggtagtaaatgagctatacaatcttaatcatttgttaggtgagaactcttggtcgcagattcaaatactgaaaatacgtgacaaattattatgagcaaaatggtgtatgtcacgtattttgaatggtaggttaaaaaataacaccgactttcgtaggtgttactaataataaagcagagtttttagatagtatcaatgtgctttgtgtatattgtggcaaataattgggttgggggtacaattgtgattgcttttgcatgaacattgcgcctttatgcataatgagataaaggaatatcaaataaaataacgataggtcataacaaagaggtttttatgaaaacacttatcgtttcaactgtattggcattcataacattttctgcgcaggctgcagcatttcaggtcactagtaatgaaataaaaacaggagagcaacttacaacgtctcatgtcttttctggatttgggtgtgaaggtggtaatacatcgccctcattaacctggtctggtgttcctgaaggtaccaaaagctttgccgtaactgtatatgatccagatgcacctacaggcagtggttggtggcattggactgttgttaatattccagcaacagtaacatatttgcccgttgatgcagggagacgtgatggaacaaaactgccgactggtgctgttcaaggccgaaatgattttggctatgctgggtttggtggcgcatgtcctcctaaaggagataaaccacatcattaccagtttaaagtatgggctctaaaaactgaaaagattcctgtagattctaactccagcggagcgttagttggttatatgcttaatgctaataaaatcgcaaccgctgagataacaccagtttatgagataaagtagggtgagagtatgctggcaagaggtaagactaacttaaagatcgaagaaatacggatgcataaacatcatgagattcatagggttaagcctcttatgccagctttgtgtcgtatccgtcagggaaagaaagttatcaattgggagacgcatactttaactgttgataataatcaaataatattatttccttgtggttatgaattttatattgagaattatcctgaagcagggctttatcttgcagaaatgctttacttacccattgatttaattgagagtttccaaaaactttatacggtaactgatcaaatacgtaacaaaacaagtttctttttacctcagaatcctgagttaatatattgttgggagcaactaaaaacatctgtttcccgaggcttctcaactaaaattcaggagcacttagcaatgggcgttctactttcgttaggagtgaatcatgttaatcatttacttttatcatatagtaaacaatcattgataagtcgttgttataacctgctgctatccgaacccggcacaaaatggacagcaaacaaggttgctcgatatctctacatttctgtttctacattacatcgccgtctagcaagcgagggggtaagtttccaaagtatactggacgatgtgaggttaaataatgcgttgtctgctatacaaacgacggtaaaacctataagcgagattgccagagaaaatggttataagtgtccttctcgttttactgaaagatttcataatcgttttaatataacaccaagagagataagaaaagcttccagagagtaaaagtgttttaagaaggagcaattctatcgattttgattttgggaaatcaacacggcataattatgtcaccggagcctgaacaactccggtgacttctgcgctaaacggggacgtttatgcgcacatacaatccaaactctcttctcccttcacagatgcagaaatgcacctgcaattctttgcatctagcgtttgacctctgcggaggggaagcgtgaacctctcacaagacggcatcaaattacatcgcggcaacttcaccgctatcggtcggcagatccagccttatctggaggagggcaaatgctttcgcatggtgcttaaaccgtggcgtgagaaacgcagtctttcccagaatgcactcagccacatgtggtacagcgaaatcagtgaatacctcatcagcaggggtaaaacgttcgccactccagcttgggtaaaagatgctctcaaacacacatatctcggttatgaaaccaaagacctggttgatgtcgtaaccggtgatatcaccactatccagtcgttacgccatacctccgatcttgataccggagagatgtatgtcttcctgtgtaaggttgaagcctgggcgatgaatattggttgccacctgactattccacagagctgcgagttccagctgctgcgcgacaagcaggaggcgtaatggctacaccgcttattcgtgtcatgaacggacacatctacagagtaccaaatcgtcgtaagcgtaaacctgagctgaagccatccgaaataccaacactgctcggatataccgccagcttggttgataaaaaatggttgcgactggcagcaaggaggagtcatggctgatttgagaaaagcagcgcgtggtcgggaatgccaggtaagaatccctggcgtatgtaatggcaaccctgaaacgtctgtactggcacatatccggctgactggattgtgcggcaccggtacgaaaccgccagacctgattgccaccattgcatgttctgcctgccacgacgaaatcgaccgccgcacgcattttgttgacgctggatatgcaaaagaatgcgcgctggaaggtatggcgagaacacaggttatctggctgaaagagggggttattaaggcgtgaatacctacagcatcacattaccctggcctccgagcaataatcgctattaccgccataatcgcgggcgcacgcacgtcagcgcagaggggcaggcataccgcgataacgtcgcccgaatcattaaaaacgcaatgctggatatcggcctggctatgcctgtgaaaatccgcattgagtgccacatgccggatcgccgtcgccgtgacctggataatctgcaaaaagccgcttttgacgcactcactaaagcaggtttctggctggatgatgctcaggtcgttgattaccgcgttgtgaagatgcctgttaccaaaggtgggaggctggaactgaccatcaccgaaatggggaatgaatgatgtttgagtttaatatggcagaacttcttcgccaccgctgggggcgtctgcgcttatatcgtttccccggttctgttttgaccgattaccgaatactgaagaattacgccaaaaccctgacaggagcaggagtatgaagtcagagataacaatcaactaatactgttttgttgatttttgcttgtaattggcgttctggtctgatttttgtggagtaagttgatgcgtgatattcagatggttcttgagcgttggggagcgtgggcggctaataatcatgaagatgtgacctggtcgtccattgccgccggttttaagggattaattacttcaaaagtaaaatctcgcccgcaatgttgtgacgatgacgcgatgatcatttgcgggtgcatggcccgtctgaaaaagaacaacagcgatttgcacgatttattagtagattattatgtagtcggtatgacattcatgtcactggcaggtaagcattgctgctctgatggttatatcgggaaaaggttacagaaggctgagggcataattgaagggatgttaatggcattagatatccggttagagatggatatcgttgttaataactctaattaatatgccaattgtttactaaaaattattaaaaatggggcgttgagacgcccccaaaaataaagggtaatatataacagaaggtttatatagttagaagcaaggttgtgcttctaaaggaagtggcttgagggagccacttatatgttggggaggcaacgcctcccgcaacatatctttttcgtaatcagattagaactggtaaaccagacctacagcaacgatgtcatcagtgcttacaccgagtgctttagggaaggtgcgaataagcggggaaattcttctcggctgactcagtcatttcatttcttcatgtttgagccgattttttctcccgtaaatgccttgaatcagcctatttagaccgtttcttcgccatttaaggcgttatccccagtttttagtgagatctctcccactgacgtatcatttggtccgcccgaaacaggttggccagcgtgaataacatcgccagttggttatcgtttttcagcaaccccttgtatctggctttcacgaagccgaactgtcgcttgatgatgcgaaatgggtgctccaccctggcccggatgctggctttcatgtattcgatgttgatggccgttttgttcttgcgtggatgctgtttcaaggttcttaccttgccggggcgctcggcgatcagccagtccacatccacctcggccagctcctcgcgctgtggcgccccttggtagccggcatcggctgagacaaattgctcctctccatgcagcagattacccagctgattgaggtcatgctcgttggccgcggtggtgaccaggctgtgggtcaggccactcttggcatcgacaccaatgtgggccttcatgccaaagtgccactgattgcctttcttggtctgatgcatctccggatcgcgttgctgctctttgttcttggtcgagctgggtgcctcaatgatggtggcatcgaccaaggtgccttgagtcatcatgacgcctgcttcggccagccagcgattgatggtcttgaacaattggcgggccagttgatgctgctccagcaggtggcggaaattcatgatggtggtgcggtccggcaaggcgctatccagggataaccgggcaaacagacgcatggaggcgatttcgtacagagcatcttccatcgcgccatcgctcaggttgtaccaatgctgcatgcagtgaatgcgtagcatggtttccagcggataaggtcgccggccattaccagccttggggtaaaacggctcgatgacttccaccatgttttgccatggcagaatctgctccatgcgggacaagaaaatctcttttctggtctgacggcgcttactgctgaattcactgtcggcgaaggtaagttgatgactcatgatgaaccctgttctatggctccagatgacaaacatgatctcatatcagggacttgttcgcaccttccttagtgaagtcatttttgtcaagcaggttgattttgtaatcaacgaaagtagacatatttttgttgaagtaataggttgcacctacatcaacatatttgactaagtcctgatcgccccatactccaagatccttacctttagattgcaggtaagcaacggacggacgcagaccgaaatcgaactgatattgtgcaacagcttcgaagttttgggctttattagcaacgaagtgatcagcaaatacagtcatattctgggtttcagaataggtagtggccaggtaaatgttgttagcgtcatatttcagacctgcggcccaaacttctgcatttttaccggaagcaaatacttcaggaagaactttccctgcattaacttgagtgtcggtacgatcagatttcgcataagttgcaccgataccgaatccttcgtattcataggtagcagagaaaccgaagccatcaccgttaccttcagtgtagttatcgaaatcgctacgatcgtttttgccttggtactgagcagcaaagttcagaccatcaaccagaccaaagaagtcgttgttacgataggttgcaacaccagttgcacgttgagtcatgaacacgtcggtttgagtccaagtgtcaccaccgaattctggcaggacgtcagtccacgcaccgatgtcgtatgctacaccgtagttacggccgtaatcgatggagccgtagtcaccgaatttcaggccagcgaaggcaagacgggttttatctttggaggaaccttgagattcagcgcggttgcctttgaattcatattcccactgaccgaaaccagtcagttgatcgttgatttgggtttcacctttgaagccaagacgggcataagtagtatcaccatcatctgcatcattagaggagaagtagtgcttagcattaactttcccgtacagatccagcttgttactgtctttattataaatttcagctgcctgagcagacatcgccattagtactgatgcagctacagcagaaattgccactgttaattttttcatcgtgagccctttttttgaactattattaaaaaatgatgtcactgcgcgataaatattcatctaatcaatgtgattatttcaagatgtaagttttggtttctcgtttgatttgtgaagtagatctctatttttatctgaacttttttctatcgaatcctattcatggctcttggctgaataaaaataaatctattagccaatttatattaacggctgttatttataagtgctctataatttgaaggttcaatttaaaccggctaaaaataacactggaaattattttttggttatttgttgagatttgcttatgtatttgtagtggtgttttcaatactcggtagcattctctcaaatatcatttagtggtttacgtacgtaaaaaattggttatgctgttaagagtggttacttcgtcacacagcttaaacccgccgtcgagcgggtttttccattttttgagtctcgatattagctgataacccaatacctgagttattcactgactccgagtctgttacgtttcgtagtattccctcaatttacacccgctttgtctgcgaggtggggttatgaaatccatggataagttaacaacgggtgtcgcctatggcacctcagcaggtagtgccgggtactggtttttacagctgctagataaagtcactccctcacagtgggcagcaataggtgtgctgggtagcctggtatttggcctgctgacgtacctgacaaacctttatttcaagattaaagaagataagcgcaaggctgcgagaggtgaataatgcctccatcattacgaaaagccgttgctgctgctattggtggcggagcaattgctatagcatcagtgttaatcactggcccaagtggtaacgatggtctggaaggtgtcagctacataccatacaaagatattgttggtgtatggactgtatgtcacggacacaccggaaaagacatcatgctcggtaaaacgtataccaaagcagaatgcaaagcactcttgaataaagaccttgccactgtcgccagacaaattaacccgtatatcaaagtcgatataccggaaacaacgcgcggcgctctttactcattcgtttacaacgtgggtgctggcaattttagaacatcgacgcttcttcgcaaaataaaccagggcgatatcaaaggcgcatgtgatcagctgcgtcgctggacatacgctggcggtaagcaatggaaaggcctgatgactcgtcgtgagattgagcgtgaagtctgtttgtgggggcaacagtgagcagagtaaccgcgattatatccgctctgattatctgcatcatcgtcagcctgtcatgggcggtcaatcattaccgtgataacgcaatcgcctacaaagtccagcgcgacaaaaatgccagagaactgaagctagcgaacgcggcaattactgacatgcagatgcgtcagcgtgatgttgctgcgctcgatgcaaaatacacgaaggagttagctgatgcgaaagctgaaaatgatgctctgcgtgatgatgttgccgctggtcgtcgtcggttgcacatcaaagcagtctgtcagtcagtgcgtgaagccaccacggcctccggcgtggataatgcagcctccccccgactggcagacaccgctgaacgggattatttcaccctcagagagaggctgatcactatgcaaaaacaactggaaggaacccagaagtatattaatgagcagtgcagatagagctgaccatatcgatgggcaactcatgcaattattttgagcaatacacacgcgcttccagcggagtataaatgcctaaagtaataaaaccgagcaatccatttacgaatgtttgctgggtttctgttttaacaacattttctgcgccgccacaaattttagctgcatcgacagttttcttctgcccaattccagaaacgaagaaatgatgggtgatggtttcctttggtgctactgctgtctgtttgttttgaacagtaaatgtctgttgagcacatcctgtaataagcagggccagcgcagtagcgagtagcatttttttcatggtgttattcccgatgctttttgaagttcgcagaatcgtatgtgtagaaaattaaacaaaccctaaacaatgagttgaaatttcatattgttaatatttattaatgtatgccaggtgcgatgaatcgtcattgtattcccggattaactatgtccacagccctgacggggaacttctctgcgggagtgtccgggaataattaaaaacgatgcacacagggtttagcgcgtacatgtattgtattatgccaacaccccggtgctgacacggaagaaaccggacgttatgatttagcgtggaaagatttgtgtagtgttctgaatgctctcagtaaatagtaatgaattatcaaaggtatagtaatatcttttatgttcgtggatatttgtaatccatcggaaaactcctgctttagcaagattttccctgtattgctgaaatgtgatttctcttgatttcaacctatcataggacgtttctataagatgcgtatttcttgagaatttaacatttacaacctttttaagtccttttattaacacggtgttatcgttttctaacacaatgtgaatattatctgtggctagatagtaaatataatgtgagacattgtgacgttttagttcagaataaaacaattcacagtttaaatcttttcgcacttgatcgaatatttctttaaaaatggcaacctgagccattggtaaaaccttccatgtgatacgagggcgcgtagtttgcattatcgtttttatcgcttcaatctggtctgacctctttgtgttttgttgatgatttatgtcaaatattaggaatgttttcaattaatagtattggttgcgtaacaaagtgcggtcctgctggcattctggagggaaatacaaccgacagatgtatgtaaggccaacgtgctcaaaccttcatacagaaagatttgaagtaatattttaaccgctagatgaagagcaagcgcatggagcgacaaaatgaataaagaacaatctgctgatgatccctccgtggatctgattcgtgtaaaaaatatgcttaatagcaccatttctatgagttaccctgatgttgtaattgcatgtatagaacataaggtgtctctggaagcattcagggcaattgaggcagcgttggtgaagcacgataataatatgaaggattattccctggtggttgactgatcaccataactgctaatcattcaaactacttaacctgtgacagagccaacacgcagtctgtcactgtcaggaaagtggtaaaactgcaactcaattactgcaatgccctcgtaattaagtgaatttacaatatcgtcctgttcggagggaagaacgcgggatgttcattcttcatcacttttaattgatgtatatgctctcttttctgacgttagcctccgacggcaggcttcaatgacccaggctgagaaattcccggaccctttttgctcaagagcgatgttaatttgttcaatcatttggttaggaaagcggatgttgcgggttgttgttctgcgggttctgttcttagttgacatgaggttgccccgtattcagtgtcgctgatttgtattgtctgaagttgtttttacgttaagttgatgcagatcaattaatacgatacctgcgtcataattgattatttgacgtggtttgatggcgtagatgcacgttgtgacatgtagatgataattattatcattttgtgggtcctttccggcgatccgacaggttacggggcggcgacctcgcgggttttcgctatttatgaaaattttccggtttaaggtgtttccgttcttcttcgtcgtaacttaatgtatttatttaaaataccccctgaaaagaaaggaaacgacaggtgctgaaagcgagctttttggcctctgtcgtttcctttctctgtttttgtccgtggaatgtgcaatggaagtcaacaaaaagcagctggctgacattttcggtgcgagtatccgtaccattcagaactggcaggaacagggaatgcccgttctgcgaggcggtggcaagggtaatgaggtgctttatgactctgccgccgtcataaaatggtatgccgaaagggatgctgaaattgagaacgaaaagctgcgccgggaggttgaagaactgctgcaggccagcgagacagatctccagccagggactattgagtacgaacgccatcgacttacgcgtgcgcaggccgatgcacaggagctgaaaaatgccagagactccgctgaagtggtggaaaccgcattctgtactttcgtgctgtcgcggatcgcaggtgaaattgccagtattctcgacgggatccccctgtcggtgcagcggcgttttccggaactggaaaaccgacatgttgatttcctgaaacgggatatcatcaaagccatgaacaaagcagccgcgctggatgaactgataccggggttgctgagtgaatatatcgaacagtcaggttaacaggctgcggcattttgtccgcgccgggcttcgctcactgttcaggccggagccacagaccgccgttgaatgggcggatgctaattactatctcccgaaagaatccgcataccaggaagggcgctgggaaacactgccctttcagcgggccatcatgaatgcgatgggcagcgactacatccgtgaggtgaatgtggtgaagtctgcccgtgtcggttattccaaaatgctgctgggtgtttatgcctactttatagagcataagcagcgcaacacccttattccagctggcttcgtggctgttttcaacagtgatgagtcatcgtggcatctcgttgaagatcatcggggtaaaacggtttatgacgtagcgtcaggggacgcgttatttatttctgaactcggtccgttaccggaaaatgttacctggttatcgccggaaggggagtttcagaagtggaacggtacagcctgggtgaaagatgcagaagcagaaaaactgttccggattcgggaggcggaagaaacaaaaaacagcctgatgcaggtagccagtgagcatattgcgccacttcaggatgctgtagatctggaaatcgcaacggaggaagaaacctcattgctggaagcctggaaaaaatatcgggtgttgctgaaccgtgttgatacatcaactgcacctgatattgagtggcctacgaaccctgtcagggagtaatcattgggattatgccgcagcacgtcttaagcaagaacatgctgcggttggatgctatttttttcctgaagcggaaaacattactacagtaccttgaaccttggttttaacattctcgaaatgctctgagagtatatgtgttaagccttcttcggaatcttttgtgtttgaaaagatgcctttctgattgtaaatgcgcatcagtttttgaccgaagctattgtgcacaactccatcgccaagaattgtggctccgtatagagttccatcgtcagttaaggcctgcgccgcattgcgtattacacagctttttgtagatatatttccaggcaggcagtgaagaaggtaagacatggaaatggaatcaaattgaccatgtaacgccgcgggataaggttcaaaaacatcatggctaattttatgtttaatttttgattccccagcccttgtagatgccgcgttcaggctagcttcgttcaaatccattaaagatatcagactactctcaggtacgtgagtaaggtaaaacccagttccaacaccaatatccagatggttgttacctaaatgttccagaaagtgtggaagaaggtgttcctttgtaggacatccccatgcaagccgatttgatactcccaaaacccaccagtcataaagctttagggtaagtggtgtgtaaattctagccccatcatctgtgtttttttattaatttcaccatgttatagttttatttgtgaattaaatcaattatggcaatgaattacaaggggttaaatgctgccgcagcatagcgatattgaaatagcctggtatgcttcaatacagcaggagccgaatggctggaagaccgtcaccacacagttctacatccaggaattcagtgagtatattgcgccactgcaggatgctgtagatctggaaatcgcaacggaggaagaaagatcgttgctggaagcctgaaaaaagtatcgggtgctgctaaaccgtgtggacacttccgtagcaccagatatcgagtggcttattcaaccataataaacagtatgtatatcataggttattaattgtgagttttttcggtgtgttatttgtttgtttgatgttatgcttttgcgccccaaaaggttgtttagatgtattttatcaattgattttcaatatcgtttaataaagaaaaattaagcaagctggatgttggttttttgttaattgaatggttctaataatgtttttttactgttgttgaatgtgacttgataagaaatgcaagtaaaaatgatactctttttattttaaattcaaacggttgacatatatatagcaagaggtttcaggtgcgttgtagtgagtttatgttaataaaaagcatagtaagcgttgaaaaatgtaactttgaaataagttagaataaaaaacaacatacatataataatttaatcttaaatgaaatttattaaaatttgcaaactataattttgtgtataaaaatataaatgcacatcatcctgattatgattgtgtatttaattggttgttatttgactactatcaacttgttttaattttatgataggtgcaagatggattatgtttgctccgtagttttcatctgtcaatcatttgatttaattataaacaggagagttatctcgttcaaaaaaaattcattgtttattgtaagcgacaaaattagaagggagttaccagtatgcccctctaaactaagaattgttgatatagataagaaaacatgtttatccttttttatcgacgtgaataatgagctgcctggcaaatttactcttgataagaatggctatattgctgaagaggaacctccattatcgcttgttttttctctgtttgaagggattaaaatagcagactcacactccctttggttaaaagaaagactatgtatatccttacttgccatgttcaaaaaacgcgaaagtgtaaattcatttatactaacaaatataaatacatttacctgtaaaattactggaataatcagttttaatattgagcggcaatggcatttaaaagatattgcggaattgatttatacgagtgaaagtttaataaaaaaaagattaagggatgaaggaacgtcatttactgaaatattgagagatactaggatgaggtatgcaaaaaaactcataacttcaaactcttattctatcaatgtcgtagcccagaaatgtggctataacagtacttcatatttcatatgtgcatttaaagattattatggtgtcacgccatctcattattttgagaaaataatcggcgtcacagatggaataaacaaaacaattgactgataatgtttattacaagttgtctacatgttaattataatattatacagcgttttttttgatgtgatattctggaaccattaatttgtaattgggttgctgtcgcctattttatacatactataattgatggttttctatgtgatttagttaataaccttctgggtttattttaagggttaattgttacattgaaatggctagttattccccggggcgattttcacctcggggaaattttagttggcgttcttaaaatgtgtacttaagaccagcagtagtgatgaagttatagttttctatacctgctccatttttgctgtagtctgaagtgttattattgtgatcataaagtgaagtattaccttttttattcgtaacccgattccatgcgccttcaacataaacttttgcgttaggtgtgacgtaataacctgcattgactgcaacagaatagtaattttggtctttgaccttactgcgataagtgattctttttcccgggtcatagtgttcatcgttatcagatgattccacccagccgctgtatttaaatgtgccaccgagttcaaaatcttcataacgataacttccagtcaagccaatgtagggcattttaaaacgttgtttgtagccgattgctctttctccattcgggaaggagccgatatcatctctgaatccctcctcagaactgtagatataggaaccacctctggctgtaaagctataacggctttcctgatatccggccatgagtcccaggcggtaattgggttcgttgaggagccagcctttgatattcagatcaaattcgttggcataattgagttgtgtatcagggtgtctactttcatccgtccaggttccggggttactggaatccatccagtcctgatcgaccatattgccacctcggctgccgagagttgtccagccagcagccccgatagatatctggggcatcaaatcccaattaattgcacctttaataattgcagcgttattgaatttccagtcgagttgactgacttttcggcctccttcttcggctagataaacacgctcttttgtttttccgctcagagttccaagactaatgtccgcatttatgttgtcaggagtaaacgataaagtctcggtagaagcaaaagagctgatcgcaataggggttgtcaggactattcccagaagtttcgcccgcataaaagttctccattcaatcgttttaatgattgaatatgtattttttatatctaacttaatgagtcaattacatattgctccactgtttatattttgtttagtattgaatgattatcacaatgcgctatctgtttttggtttaattatctgttattgtttcatatttcggttttactgtgtggtttttttatgcttttgtggtgcttttatctatttaagtgccatgcctttagaggcatataagcgaaaatagcatgaggtttatcctcaattactatgttttttagtacaaaaaagagggacaaaactgagacacataaggcctcgcaatggcttgcaaggctttacatgttttgaggtagtgggacgtgtgagcgcagagatggcgcggtaagttgttgacttaaaatgtcgttctaggaacttctaagtcgtgggccgcaggttcgaatcctgcagggcgcgccatttcttcctcatttatgcccgtcttatccgtttccgctttgcccttcaccacatcactttttgtcgctgtttggcgagataattcaacggtgtcaggccgtaaaacgccttaaaaacagagataaagtacgacgtgctgctatagccacataattgcgccacctgagtgatatttttgttatccatcaataacatctgtacggcgtaacgcatacgacactctgtgacaatctggctatagctggtattttcgttttttaatttctttttgagcaggctggggcttaaacatagcgaactggcgacaattcgcagattccagtaatgctgaatatcgctttgaataatgcggcagacgctgtcgcggacgctgctgcgtaagatatacatcagtagggcaataaaccgcgattgctcaagaaagttagacaatacggtaaaaagcaatgcgcgcgtcaactccgcttcgcagggtctgctgggttgctgcttgctgtggttggcggctagccggaacacttccggtgtacggctatgacaagcgataaccggggttgccagccgcgaccagggctttacacaggttaagttcttatttaaaaacaacagataatcgttgatgatgttacggttgatgtgggtgattaatacgtgatttaacgttgagagttcaatgacgttattgttgcacgcgaaggcggccaggtagtttttcggaagggtaaacgtagcatggttattgacgcttacctctacctctttttcggtcaggatcaccacgcaaggttcactgctgctcaattgcatttcgcactcctcagatatcagaaactccgctcaaaggatctatgcttcctgcatgagtgatcggcccgttcgccgataacgatcttctttctttagcacgctttttagcaattaatcttgatggaattctgatgagagcgaaagaggtaagccaggtcgtacccgacttacctggaggagatttaatactcgagaatgccgtgcgcgacgggcaaatagcgcagagagaaatagagagtgtctttaccgcaagaggaacgtttcgctaacagcgaggcaatttctgcgtccggtttcggtttcgctgtaaaggttttgcctttgccggcgacaaaaagttcataaacaacgccgctggcaggggcgggactttggcaatcggcgctggcctgtaaataacgttcacgctgttcagcggtcagtttatccacgccgctgccatcctgtacccagacattaacgccggttgctttaacgtgttccagcagttggcgatagccatcgggcgacatgtttccggcgaaaaaactactgatataaaccggttttgctgaaacatcgctaatcagccgctgcgcgttgtttaaccatgttagcaaaggctgacgggcggcttcgctgcgccagttcaggtcgtcaatttccgcgctgatgtaccagccatccggcgttatgccaggcgcggcgctccataatctggcttgctggagatcggcagccagcaggcgattaagatagctttccagcgctgcggacgactgtttctggtgcataaaaaattccggatcggcgttcagcccgacaataagcttcagaccagcctgttgcgcagctgcggcccgcttaaacaataacgtgcgctgttctggctgggtaaatgcatcgccgtaacgggtccattgcaaaacaagggtatcgaagccttgcaaacgtaactgactcatcagcccctgccactgggtatcggtaacctgactatctcggttttgtggttgccagataatacctttcatcgcaaaggaaaaagggctgaccaaaagcagtgtcagcaatacgaaaatgaacttacgcatttaccagtgcactccaatggtgagaaacgcgttgttgcgctctccgttacgttgattaatcgccttaaaggtatgttgatactcgacgccgagactgactttgtgcggccaggcgtcgtagtgcgtctcgccggtccagatattccagcggaccccgactccgccaagctgcgcgccctgagtgcctttatcacgatagccgttgtcctgaacgtgagcgtaaggctcaatagtctgtccgttagctaccttctgatgccagctgacgcgataatctgccgtccacgcctgaatatcctggcggatatattgcgccgcatcgaggtacaggttttgggcaaaccagcctgaaccgttcgggtgccattcgtcgctgtatttgccgccattaaagaatgaggcgctggcgcgcagcatggtatcggatgcgccattttggccgttcagcggcaactgctgttcgacggcgatgaaaaagatctgatcgcgcagcggcttccagcgcagaccggtgccggacatcggatttttcaccggcatcatcaccccgttttctccggtatcggcaaagacgcggctataaactgagagcaggtcgccttccagcagcatattgcgtccgatgcggtactcggcttccagttgtccgtagctacgatagcttttccctggcgctgcgccgccgacattattgttagcggtactcattgcgccggaacgcaagccgatggaagaatcgaaactgaacgtccagcggcgaccgacctcctcatgcaaacggcggaaattgaagcgttgttgattttgttctggggtcagtggggttatcagcgcctgattatcaatgtcatcaatcaccagccgggcgtagtgctgcgtcgcaggcatgtcatccagacgctggttcacgtaggccagttgtcggatcagtgccggatcgtccggaagccctttatgcgccggttcgagcatttcccgcgactgtgcgatatcaccgctatcccacaaggcgtaaccaagcgctgcctgggtgttgctattattcggttccagttccagcgcggcgcgcaaatcactcaccgcggccgggacattatgacgttggcgataaattgtcgcccgcgcaacgtaagcgttggcagaaggcgcaatattgattgagcgcgtgagatcgttcagtgcgagttccggctgaccaggaatgtaacgttgcgcatgcagccaccagtagagggcattgcttcccagtccacgtttttctgcctgttgtagccagcgatcgcgagccgcaccatttcctgccgcctgggcggtattggcagcagcaagcagatcctcattgctcatgtcgtgaagactgattttctgccaggccgccagtgcggtggcgtagtcctcaacctgatacgcctgataggctaccgcacgatgttgccaggcgctcggttgtcgttgttcggcctgaagccatgcatacaacgccacaccgggtagcgtgtcccgataacactttgccagacggttccaggcggcggcatcgtaggaaggcgacatatcgcccagcaagcgaactattgccgggcaattatctgcaatacccggcaactgactttgccactgacgttgctccgccagcggtaagggtttcgataaaatcgccaccttcgccggcgttgccaggtaaggatgactttccagcagagacgccagtcgcgccattaaagtctggctgacacgcgcatcgccctggaaaggatagcgttgcagcaataaatcggcagcttcgcgtgactgctcgttctgcatcagttgccaggttagttgatccaggcgggtaagatttgccggttcttgctgatacagcaatcgtgccagacgcagagcttcagccttgttacgggtcgccacgctgacagcataacgctcctcaagcatttcattggcggggagggtggcgagcagtttttgcgctgcgtcgtactgaccttcttttaacagcaccggtagcgtcgcgccaacaacatactggcggttgtcggcaaactgtaccgtataattcgccaacgcctgaacggggttagcgctgtatttagataacagatagagccaacttttctcttgtgcgtccgtggtaaatagtggcttattttcaatgagataatgctggaggcgtgctttttcgccacgataagccagcgcggtcgcgtaagtaatatatgactgaggatcggtgaagatcccctgtgattgcagtgccaggatccgatcgtccagctgcccggcaagaagcacgtcaaaccactgacggcgttctgccgcgcttaatgtgttctgctggcgtgcttcattgtatagcgtatctgcctgggaccattgtttcaggtagattgcccgttgcagcagatcggttcgcagcgtttttccttccggcgatgcagcaaacgtcgcatcgttcagttgcgctctggcgacaggtaactgtgccagccgcagggcattctgcccgacttcactgcgacaacgcagggtcggcgcagcatcgcacgctttttgctgggcaagcagttcttcaactgtcgtaacgcttttcacttcaaccggaatagccgccagactgcgctcaagtcgggcatctcctgggtgacgtttcagttgatcctcaagcaacagccgcgcccggtcatcatgaccaaaatggcgataggcttccgcaaggtataaagtcagcggaatattatccggcacctgctggtgtatatattcaaattcgcggatggcggttgcttcgtcgttatttttctgtgccttcagcgctttatcgagacggggataaataacaaaatggcgataatcgctcagccccagctcttctgcgctggtgccgatattgtctgcgagtgcgctggtactcaataaagacgtcagcagtaaaccagaccatccgatgacgcgattaaggttattctccttcattttcggactccagttgcgcaacctgttctgtgtttaaacctgctttgagtaatagtgattgcatcgaaacttgtaattcgcgttgaattgtcaggacgcgatccaacgtttcctggctgataacgccttcggtgaccaaaaacttgccgagcggcagagaactgcgttcatggcgcaataacaacacgttaattgctgaacgattaatatgaccgagcgtggtcagtatttcggcgaacaggaactgatgcggcacatattgccgccagatttcaccggcctgctgttccgtgagccactgatgctgaaccgcattgtacaacattgcccgcggatcgtgaccgcgtcggcgtgcataccagtgacgtaaccctgtgacaatttgtccccgcagaacaatgacgtaacgcactttgcgtccgactttacgcgtcagggccgccagcgaaaccgggtcaataccatcttcactgccgacaattaactcgtcattttccagacgcagcggcagtaccgcataatgcagcgccacggaggccggcatttcggcaatcagcgaggaagggatctgccaggcatcgatggattcccacgccacgccgttttgctctgccagcgcctgtgccagctgctcggcgctaatcagcccctgcatcagcattgaaccgcccaggcgtagaccttcgacgcgattacgcagtgctgtatcgagttgttcttcagtgatgacctgattttccagcagaatttgacctaacgggcgcaacgagcgggtatcgccagtcacgctggggaagtcatgcgttgttttatcccacgccacgcgacgtggatcgccgtgttgaagtacctgttttagcgcgcgccagttggccatgaagttaatcaggttgccccagaaaagacgcaggacggaaagcagcccctgcgtcaggccgtagtagccagtaacgaaaatcacccgctgcacgatgcggttaaccatcaaaccaaagtttagccacagcagggtcattaaccatgcgctgccgctgaaaatagaaaggaaatgccaggcatcgggccacaaactttcatacgccagcaacagcaaaagctggatcatcaccagcatcgcgaggaagctgacaaagttactgattgcccctttgcggtcgcgccagagaaagtagttcagcgtcaggctggaggtccatttatgggttttaaagccttggaaaacaatgccgatgatccagcgggatttttgtcgaaccgcagtcgaaaaggtatcggggaaatattcgcgcacgcagatcatgtttgatgtccgcgcgtgctgtaaaaatttacgctgctcgcgttctttggcttcgtccaccaccggaaaacggacaaaaatttccgtcatacctttttctttcaggcggaagccaatgtcgtaatcttcagtaagactctgcacgtcgaaagcaataccgtcaccgtcagctaacagtgcggtcacggcgcggcggctgaaacaggtgccgacgcctgcgctgggcacttgtccggcgagggcttcacgcaccggaacatctttgccatgcagctctgaaaactcatcaatgtaagtcatgctggtgaagtgcgtccattcgcgttcgaacggatacaccgggatctgaatcagatctttacgctcgaccagatagttgaacagacgcaattccatcggtgaaatcacatcttcggcgtcatgcagaataaaaccagcaaaagcgaaattggcgctacgctcaaattgggtgatggcgtccagcacgttgttcagacagtcggctttgctggtggggccaggacgcgcgcagactaccttatgcacattcgggaagcgagcgcacacttcgtcaacatcacgctgagtatcggggtcgttggggtaggtgccaacaaagatatgatagttttcgtagtcgagcgtggtcgccgccagctcggccatattgccgatgacgcccgtttcattccacgccggaaccataatcgctaacggtttttcatctggtttatacagttcgcggtaactcattcgcgggtagcggcgataaacactcaacttgcgtttaatgcggcgtacccagtagacgacatcaataaaaaaatcgtccagcccgctgatgaacatgatgaccgctaacgttatcgcgattacttttaagccgtagagccaggtagcaaaaacatcaagaagccagtccacacaaaaaccttacattaacgctggttatgtttagggtggcgtatattaaggttttttatgaattgtgacagctttttaccattaataggtatgactattgcggcacgttatttttacactggttataaaagttgccgtttgctgaaggattaagcgggtaatgtgataacaaaccttgtcccccgcgcatccgacgttaccgcaaccgtgcctttatgcgcgacaacaatcgatttcactatcgccaggccaataccgctaccttcaccttttcgctggcgggaggggtcaacgcgatagaaacggtcaaacaatcgcggtaagtgctcgggcgcaatgggcgtaccggggttttcgacgataacttgcaccaggtgatcgaccgtctgacagcgcactacaattgtctctccggttggcgtataacgcagggcgttcgaaagcaggttgcttagcgcccgacgcagcatcagcggatcgcccgcgacctgacacttgtcgccaacaaaccgcaactccacgccgcgatcttccgctaacgcctcgaaaaaatcgaacactttgccgacttcatccgccaggttgagcattttcttttcggggattagctggttgttatcggcctgagcgagaaacagcatatcgctgaccattttcgccattcgcgtcagctcttcgagattagagtagagcacatcttccagctccttctggctgcgcgactggctgagggcgatttcggtttgcgttatgagattcgtaattggtgtgcgaatttcgtgagcgatatccgctgagaaattggactggcgggtaaagacatcctcaatacgctcgatcatatggttgaacgacagtaccagctgttccagctcaatgggcacggtctgcgggtcgaggcgaacgtcgagatctttcgaggtaatattctggatttgacggctgacgctgcggatcggcgcgtgacctttatgtaccgccaacagtacgataaagacgatcaggatgctgattaccgatgcggtcataataagtttattcatcaaatcatttatgtaatgaagatgaaaatcgatcgaaagcgcgatgtagagcgtataaatcggtttgccgtccaccaacgggccaaccggcaagttaatcatccgccagttgctgtgttccatatgcccgtgaccgtggcctggcatcatcatcgtcgggccggaaaggagatacacctcgccaccctgagcgtctttatcgggtatggcgtcacgcgtaaactcgcggatatccggcgcaccgggggagtgatacaccgttttaccctgactatctgccagggaaatcaacacattggaataaccactgacgatatcttccagcgtcattaagcgtcgggcttgcgtttcgtcagggtgatttagtacccgttcaagggtggcgctaatctcttttaaatcattaatatcctgctcggcaaaatgaacttttactgagtggatcatgatccatgcaaaggcgaaaaacgccgcgatggtggccaggctgataaaaaaggtcaggcgggttgccagcgaaaacgggcgctgaaatggcttactgaccatccggcacctcaagcatgtaacccacgccgcgcacggtctgaattagcttcggctcaaagtcgttgtcgattttgccgcgcagccgcttcaccgccacatcaatagcattggtatcgctgtcaaaattcatgtcccatacctgcgaggcgataagcgagcggggcagcacttcgccctgatggcgaaggaagaactccagcagagtaaactctttactggtcaaagtgatgcgcgtgccgctgcgggtgactttgcggctgacgagatcgaccatcaaatcggcaacctgaaactgactttcgataatcaccgccgccccgcgccgcagtaatgtgcgcacccgcgccagcagttcagcaaaagcgaatggcttcaccaggtagtcatctgcccccaactccagccccttgacgcgatgttcaatggtgccaagcgcggtaagcaacagaatcggcatccctttattggcggagcgtaacatgcgcacgatatcccagccgttcacgtccggcagcataatatcgaggattatcagatcataatcaccggtcatcgccagatggtagccattcagcccgttgtcggccaaatcgaccacaaaaccggcttcggttaaccctttggtcaagtattctccggttttcttttcatcttcgacaatcaacagtttcatatttcctccgcatgttgcccgggcaattctagagtagcgggatcagatggcaatcgcttattggcaaaatgacaattttgtcatttttctgtcaccggaaaatcagagcctggcgagtaaagttggcggcataaaatcaccagaaattatgagcctatgtctccttgtaaacttctgccattttgtgtggcccttgcgctaaccggttgttcactggcaccggattatcagcgtccggcaatgcccgtgccgcagcagttctcactcagccagaacggcctggttaacgcagcagataactatcagaacgcgggctggcgcaccttttttgttgataatcaggtgaagacgctgattagcgaggcgctggtgaataatcgggatttgcgcatggcgacgctgaaagtgcaggaggcacgggcgcaatatcgtctgaccgatgccgaccgctacccacagctcaatggcgagggcagcggcagctggagcggtaatcttaaagggaataccgccacgacacgggagttttcgaccggccttaacgccagctttgacctcgattttttcggtcgcttaaagaacatgagcgaagccgagcgacaaaattatttagccactgaggaagctcagcgcgcggtgcatattctgctggtttctaatgtcgcgcaaagctatttcaatcagcaactggcgtatgcgcaattgcaaatagccgaagaaacgctgcgtaattatcagcagtcatatgcgtttgtcgaaaaacaactgttgacaggtagcagtaatgttctggcgctggaacaggctcgcggggtgatagaaagtacccgcagcgacatcgctaaacgtcagggggaactggcgcaggcgaataatgcattgcaactgttgctgggaagctacggcaagctgccgcaagcgcagacagtaaacagcgacagcctgcaaagcgttaaattaccggcgggattgtcgtcgcaaatcttattgcagcgcccggatattatggaagctgaacacgcgttaatggcggctaatgccaatattggcgctgcacgcgcggcattttttccgtctataagcctgaccagcggaatatcgaccgccagtagcgatctatcgtcattatttaacgccagcagcgggatgtggaattttatacccaaaattgagatccccatttttaatgccggacgcaaccaggccaatctggatatcgccgaaattcgccagcagcagtcggtggtgaattatgaacagaaaatccagaacgcctttaaagaagtggcagatgcgctggcattacgtcaaagcctgaacgatcaaattagcgcccagcagcgttatctggcatcgctgcaaattactttgcaacgggcgcgggcattatatcagcacggcgcagtaagttatctggaagtgctggatgccgagcgttctttatttgcaacccgacaaactttacttgatctgaattatgcccgtcaggttaacgaaatttctttgtataccgcacttggtggcggttgacagcaatatactcgtcatacttcaagttgcatgtgctgcgtctgcgttcgctcaccccagtcacttacttatgtaagctcctggggattcactcgcttgtcgccttcctgcaactcgaattatttagagtatgacttttaactccaggagagaataaatgaaaaaagcactgcaagtcgcaatgttcagtctgtttaccgttattggctttaatgcccaggctaacgaacatcatcatgaaaccatgagcgaagcacaaccacaggttattagcgccactggcgtggtaaagggtatcgatctggaaagcaaaaaaatcaccatccatcacgatccgattgctgccgtgaactggccggagatgaccatgcgctttaccatcaccccgcagacgaaaatgagtgaaattaaaaccggcgacaaagtggcgtttaattttgtccagcagggcaacctttctttattacaggatattaaagtcagccagtaacccaggtttaatgagatgaaaaaaatcgcgcttattatcggcagcatgatcgcgggcggtattatttctgcggcaggttttacctgggttgcaaaggcggaaccgcctgcagaaaaaacgtcgaccgcagaacgtaaaatcttattctggtacgacccaatgtatcccaatacgcggttcgataaaccaggtaaatcgccgtttatggatatggatctggtgccgaaatatgccgatgaagagagttctgcgtctggtgtgcgcattgacccgactcagacgcagaatctgggggtgaaaacggctaccgtcacgcgcggaccgctgacttttgcccagagtttcccggcgaatgtcagttacaacgagtatcagtatgccattgtgcaggctcgcgctgccgggtttatcgacaaggtgtatccgcttaccgtgggcgataaagtacaaaagggcacaccgcttctcgacctgaccattcctgactgggtggaagcgcagagtgagtatttactgctgcgcgaaaccggcggtacggcgacccagactgaaggcattcttgagcggctgcgactggcgggaatgccggaggcggatattcgccgcctgatcgccacgcaaaaaatccagactcgctttacgctcaaagcgcccattgatggcgtgatcaccgcgtttgatctgcgcgcgggaatgaatatcgccaaagataacgtggtagcgaaaattcagggtatggacccggtgtgggtcactgctgcgatcccggagtctatcgcctggctggtgaaagatgcctcgcagtttaccctcaccgttccggcgcgaccggataaaacactcaccatccgcaaatggacgctgctacctggcgtggatgccgcgacccgcacgctgcagctgcgtctggaagtcgacaacgccgacgaggcgctaaaaccgggcatgaacgcctggttgcaactcaacaccgccagcgaaccgatgctgctcattccgtcacaagcgctgattgataccggcagcgaacagcgggtgattaccgttgatgccgacgggcgctttgtaccgaaacgcgttgctgttttccaggcatcgcaaggcgtcaccgcattacgctctggtctggcggaaggtgaaaaggtggtttccagcggcctgttcctgattgattccgaagccaatatttctggcgcactggagcggatgcgctctgaaagtgctacccatgcgcattgagggaataaccaatgattgaatggattattcgtcgctcggtggcgaaccgttttttggtgctgatgggcgcgttgtttctgagcatctggggcacctggaccatcattaatacgccagtggatgcgctgccggatctctccgatgtgcaggttattattaaaaccagctatcccggtcaggcaccacaaatcgttgaaaatcaggtgacttatccgctaaccaccaccatgttgtcggtgcctggcgcgaagactgtgcgcggtttctcacagtttggcgactcttatgtgtatgtcattttcgaagatggcaccgatccgtactgggcgcgttcgcgggtgctggagtacctcaaccaggtacagggtaagctgcctgcgggagtcagcgccgagctggggccagatgccacgggtgttggctggatctatgaatatgcactggtggatcgcagcggtaagcacgatctggccgatttacgctcattacaggactggtttctcaaatatgagctgaaaaccatccctgacgttgcggaagtggcgtcggtgggcggtgtggtgaaagagtatcaggtggttatcgatccccagcgcctggcgcagtatggcatcagtctcgccgaagtaaaaagcgcgctggatgcttcaaaccaggaagcgggcggttcgtcgatcgaactggcggaagcggaatatatggtgcgcgccagcggctatctgcaaacgctcgacgactttaatcacatcgttttaaaagccagtgaaaatggcgtgcccgtttatctgcgcgatgttgcgaaggtccagattggcccggagatgcgccggggcattgccgaactaaacggcgaaggcgaagtggcgggcggggtggtgatcctgcgatccggcaaaaacgcccgagaagtgatcgccgccgtgaaggacaaactggaaacgctgaaaagtagtctgccggaaggcgtggagatagttacaacatacgatcgcagccagctcattgaccgcgccatcgacaacctcagcggcaagttgctggaagagtttattgtggtggcggtagtctgtgcgctgtttctctggcatgtgcgctcggcgctggtggcgattatttcgttgccgctggggttgtgtattgcttttattgtcatgcacttccagggactgaatgccaatattatgtcgttgggtggcattgcgattgccgtcggggcgatggtcgatgctgctatcgtcatgatcgagaatgcgcataaacggctggaagagtggcagcaccagcatcctgacgccacgctggataataaaacgcgctggcaggtgatcaccgatgcgtctgttgaagtggggccggcgctatttatcagtctgctgattatcacgttgtcgtttatcccgatcttcaccctggaagggcaggaagggcgtctgtttggcccgttggcgttcaccaaaacgtatgcgatggcgggtgcggcgctgctggcgatcgtagtgatcccgatcctgatgggctactggatccgtggcaaaattccgccggaaagcagtaacccgctcaatcgctttttgattcgtgtttatcatccgctgttgctgaaagtactgcactggccgaaaaccacgctgctggtggcggcgctttcggtgctgacggttctctggccgctcaataaagttggcggggaatttttaccgcagatcaatgaaggcgacttgttgtatatgccatcgacgctgccggggatttccgcagcagaggcggcgagtatgctgcaaaaaaccgacaagctaattatgagcgtacctgaagtggcgcgggtatttggcaaaaccgggaaagcggaaaccgccaccgattctgctccgctggagatggtagaaacgaccatccagcttaagccgcaggagcagtggcggccaggcatgacgatggacaaaatcattgaggaactggataacaccgtgcggctgccggggctggcgaatctgtgggtgccgccaattcgtaaccgtatcgatatgctctcaaccggcattaaaagccccatcggcattaaagtttccggcactgtgctggcggatatcgacgcgatggctgagcaaattgaagaagtagcgcgaacggtgccaggcgtagcttctgcgcttgccgagcggctggaaggtgggcgctatatcaacgttgagattaaccgtgaaaaagccgcacgttacggtatgacggtggcggatgtgcagttgtttgtgacttctgcggtgggcggggcgatggttggcgaaacggtggaagggattgcccgttatccaattaatctgcgttatccgcaaagctggcgcgatagtccgcaggcactgcgccagctgccgatcctgacgccgatgaagcagcaaatcaccctggcagacgtggccgacattaaagtctctaccggaccgtcgatgctgaaaaccgagaatgcgcgcccgacgagctggatttatatcgatgcccgcgatcgtgacatggtgtcggtggttcacgatttgcaaaaagcgatagctgaaaaagtgcagttaaaaccgggcaccagcgtggcattctccgggcagttcgagctactggagcgcgccaaccataagcttaaactcatggtgccgatgacgttgatgattatcttcgtgctgttgtatctggcgttccgtcgggtgggcgaagcgttgctgattatcagcagcgtaccgtttgcgctggtgggcggcatctggttgctgtggtggatgggctttcatctttccgtggcgacgggcactggctttatcgccctcgccggggtcgccgccgaatttggcgtggtgatgctgatgtatttacgtcacgccatagaggccgtgccgtcgttgaataatccacaaacattcagcgagcagaagctggatgaggcgttatatcacggcgcggtcctgcgcgtgcgcccgaaagcgatgacggtggcggtgattatcgccggtctgctgccgattctgtggggaacgggggctggttcagaggtgatgagccggattgccgcgccgatgattggcggcatgatcaccgcacctttgctgtcgctgtttattatcccggcggcgtataagctgatgtggctgcaccgacatcgggtacggaaataaaagcaggataccccgtttaaccgtgtggattgtgtcttgcgacgatgggcactaaatgttaaaaggtgcccctcaacaaaaaagacacacaggggaaaggcgtgaaaaacgcgtcaaccgtatcggaagatactgcgtcgaatcaagagccgacgcttcatcgcggattacataaccgtcatattcaactgattgcgttgggtggcgcaattggtactggtctgtttcttggcattggcccggcgattcagatggcgggtccggctgtattgctgggctacggcgtcgccgggatcatcgctttcctgattatgcgccagcttggcgaaatggtggttgaggagccggtatccggttcatttgcccactttgcctataaatactggggaccgtttgcgggcttcctctctggctggaactactgggtaatgttcgtgctggtgggaatggcagagctgaccgctgcgggcatctatatgcagtactggttcccggatgttccaacgtggatttgggctgccgccttctttattatcatcaacgccgttaacctggtgaacgtgcgcttatatggcgaaaccgagttctggtttgcgttgattaaagtgctggcaatcatcggtatgatcggctttggcctgtggctgctgttttctggtcacggcggcgagaaagccagtatcgacaacctctggcgctacggtggtttcttcgccaccggctggaatgggctgattttgtcgctggcggtaattatgttctccttcggcggtctggagctgattgggattactgccgctgaagcgcgcgatccggaaaaaagcattccaaaagcggtaaatcaggtggtgtatcgcatcctgctgttttacatcggttcactggtggttttactggcgctctatccgtgggtggaagtgaaatccaacagtagcccgtttgtgatgattttccataatctcgacagcaacgtggtagcttctgcgctgaacttcgtcattctggtagcatcgctgtcagtgtataacagcggggtttactctaacagccgcatgctgtttggcctttctgtgcagggtaatgcgccgaagtttttgactcgcgtcagccgtcgcggtgtgccgattaactcgctgatgctttccggagcgatcacttcgctggtggtgttaatcaactatctgctgccgcaaaaagcgtttggtctgctgatggcgctggtggtagcaacgctgctgttgaactggattatgatctgtctggcgcatctgcgttttcgtgcagcgatgcgacgtcaggggcgtgaaacacagtttaaggcgctgctctatccgttcggcaactatctctgcattgccttcctcggcatgattttgctgctgatgtgcacgatggatgatatgcgcttgtcagcgatcctgctgccggtgtggattgtattcctgtttatggcatttaaaacgctgcgtcggaaataaggcattcacgctacatccgacaaaacgatgtcaaccatccgaaaccgctctcatccattcgatgagagcggtttttttaattactgcttaaatgcacccgccagagagcgaatatcattgccggttggcgactgatgaagtcgcagaccaaactcttcgacaatcgcaaatatgtgatcgaatatatcagcctgaatgctttcatattccagccacaccacggtgttagtaaacgcgtagatctcgagcggtaaaccgttatcacctggagccagttggcgtaccattaaggtcatatctttacgaatccgcggatggttacgcagatattcgttcagataggcacgaaaggttccaatattggtcattcggcgcagatttaataccgactccgtagaaccttgctggcgattccactcattaatttcctgatggcggctggttaaataaggctttaacaaatgcgctttattcagacgttgcatttcgtcttcatcaagaaaacgaatactggtgacatcaatactgatactgcgcttaatacgtcgcccgccagatgctgacatcccgctccagtttttaaaggagtcagaaaccagagaccaggtgggaatagtggtaatggtattgtcccagttacgcactttgacggtggttaacccaatatcgatcaccgcgccatccgcgccgtatttcggcatctccagccagtcgcccagtttcagcatatcgttcgcggaaagctgaatacctgccaccagaccaagaatcggatctttaaataccaacatcagcacggcagccattgcaccaagaccgctgatcagaatcgctggcgactgaccaatcagcagcgagatcatcaaaatgccgaccagaatcgcgccgatcagtttaatcccctgaaatatccctttcagcggtaactgagatgctgccgggaatttctgcgccagattcaaaataacatccagcaacgagaagactgaaagcagcgcatacatcatgatccacaactgcgcgcaggtagtcagaatatctgccgcttcggtgcctttttgcagccagaataccgcctgaatattgacgataatcccctgcagggtaaaagctaaacggtggaagagtttattctgggtaatgatttgcaaccaaagccgtgaactggcgatggcacgtttttcgaaggtccgcagtaccacccaatgcaaaataatatgcaccacgacggcggtcagaaaaataataccgaaaatcatcaccatcgaggtggtgtgatcgatctcaatacccgctaaatcttcaacctgggatattaaatcctgcataacgtctcctttatacaacagcagcctatgatgacggctgaaacagggttatgcaaatcaggagaatctgagaggaaatagccgggcagatgcccggcaagagagaattacacttcggttaaggtgatgttttgcggcagacgagatttcggcagcgtagcgttaaaatcttcaacgctgtgatgacctaccggaacaaccaccagactggtgtagcctttctctttcagaccaaattctgcatcgaggatggcggcgtcaaaaccttcgatgggtaccgcgtccagacccagagccgccacgccgagcaggaagttaccgacgttgagataaacctgttttgccatccactctgcatcatcatgcagatctttacggtgcatatcagcgaagaacttgcgacctttatcgttcgcggctttcgcttccggcgtggcaaagcggccatcggcatcttcctggtcaacaaccagcttcagccagacatcgtccatcgcggtttttgcacagaacaccacgacgtgcgaggcatcaagcattttacgctcgttgaacacgtaattaccggcagcggatttggcaacacgcgctttaccttcttccgtgctggcaacaataaaatgccacggctgggagttggtgctggatgggctgtattgcagtagcgttttgatctgctcggcctgttccggggtaagttttttgctggcatcaaatgccttagtggaatgacgctttaaggcgacagaaatgatatccataaagactccatgtgaaagtaattttgcgtgccagcagattacaaggttcaacgagaaatggtaagcgagaaaaatgcgctatagatttccgctttagcctggacgcactcttttttgatcgcgtttagccagaccatcaaccaccagattccacgaatcgttgatcagatcgcgaagtaacgcttcggagatttcttcgccgggatacactgaaatccagtgctttttattcatgtgataccctggcttaatgcttgggtatatttgctgatttaacagggatttttgtggatcggacttcagattgataaaggggacgccgcgtagctccgacgacagcataaaaatcttgccgccaattttaaaaacatcgaactccgggccaaaaggccagcaaagctcgacaaagggtaactcaagggccaggcgtttcgccgtttcgtgcagtgattgcttatccataaacgttcctttaggcgaaggagaataagcaaagtatgccgcgaagtacggcgataatcgacgtttaatccgccagcgagaaccagcgtcgccagataaagcgcagaacaaaatactcaatagcgcccagcactaaaaaccacagacaaaacaataaagtgtaaagctgactaagatccatcagatggaacatggtcaccagtttttgtgccagcgccagccccagtgcgggggcgggcagcagcaggcaagagaggaaagccatcagcaaaatgcctgctgcggtggtcaaggtttctaaagggtgtttcataacattgttaaatgtaagttaaaacaccattgtcagggatattcttctgtaaggcaattcccggcttagtcaccggcccagatctcacaatgctttttcaccagcccaatcagcgagccgccatcggcgacgaaatcgcgcattagctgcgcttcattcagaccgctgacgacctggcgatgcagggcctcaatcgcgctcgatgcaccaattttatgtgcggaaggggcgattttttccagcaatcgcaaggtatcttccgttagcggtcgacgatctccagtgtgcggatcggtgatgacgccttcaagcccatagcgacaggcctggaaacggttgaatttatacagcaggtaatctttttcctgatgtttaaacgggcgttccgtcagtaaccagtgggcggtagcctgaattaatcccgccatatttactgcgtggctaagggttaacggggtatccatcacccgaacctccaccgtgccaaaatgaggactggggcgaatatcccagtgcagatctttaatgctgtcgatcatcgtggtgtaactcagacagcgaaacagggcttcaaattgttgccagttactgacccacggcatcgggccattatcaggaaaggcggaaaaaatattcggtcgtgaggaggcaaaacgcgtatccgttccctgcatatatggcgacgcggcggaaagggcgataaagtgcggcacaaatcgtgacaagccgtgcagcaaataaatggcgtcatcgccactggcgcagccaacatggacatgctgaccaaaaacggtcgcctgctgaatgagataaccaaagttttccagcgtgcgttgatagcgttcgttatcgcatacctcctgacgctgccatttctgaaacgggtgcgtgccaccgccgcaaatttccagatgatggtctgtggctgcctgcaatacgactttctgcatcgctgaaaactgcccggcagcctggttgatatcacggcaaacatccgtcgccagctccagcatactttcggtgatatcgtgctttacctctccggccgtgatcttatttttaaccgcgtcaatcagcattgaagagtcctggcttaagtcatagcccggcggattaaccacctgcatttccagttcaataccgagggtaaaaggttcagaaacatgaaaatcgggtaatggcataggtttctcttatgttggcgttttctattcagtatagaagtcggagcggctgggcgagatgcggaagttctggaatgtttcttttttttggtgatggtgaactgatggtgcctgaagcaatttggctacttttgcaatgtgacaagttatggcagtgctgactggtggcgaagaattttgacgattgagtcatgcagaaaaaaacgggttcagcttcagttgattaaatgaggagtgagaagtccgaaacaggactcactgtataaataaacagctattttgttgaggaagggtaagataacggcgggtgcctgaagctttccggtttcaggtttactctgaggtctggaaagatgaagccccaggagatatttctatcaaccctggggctgccactccaaacccgaacaatttggatggtagtcccttcttcgcatggaggcaatataaacatgctgacgaaatatgcccttgcggcagtcatagtgctgtgtttaacggtgctgggatttacgcttctggtcggagactcgctgtgtgagtttacggtgaaggaacgtaatattgagtttaaggctgttctcgcttacgaaccgaagaagtagccgttgtgcggggagtaatcccataagcgctaacttaagggttgtggtattacgcctgatatgatttaacgtgccgatgaattactctcacgataactggtcagcaattctggcccatattggtaagcccgaagaactggatacttcggcacgtaatgccggggctctaacccgccgccgcgaaattcgtgatgctgcaactctgctacgtctggggctggcttacggccccggggggatgtcattacgtgaagtcactgcatgggctcagctccatgacgttgcaacattatctgacgtggctctcctgaagcggctgcggaatgccgccgactggtttggcatacttgccgcacaaacacttgctgtacgcgccgcagttacgggttgtacaagcggaaagagattgcgtcttgtcgatggaacagcaatcagtgcgcccgggggcggcagcgctgaatggcgactacatatgggatatgatcctcatacctgtcagttcactgattttgagctaaccgacagcagagacgctgaacggctggaccgatttgcgcaaacggcagacgagatacgcattgctgaccggggattcggttcgcgtcccgaatgtatccgctcacttgcttttggagaagctgattatatcgtccgggttcactggcgaggattgcgctggttaactgcagaaggaatgcgctttgacatgatgggttttctgcgcgggctggattgcggtaagaacggtgaaaccactgtaatgataggcaattcaggtaataaaaaagccggagctccctttccggcacgtctcattgccgtatcacttcctcccgaaaaagcattaatcagtaaaacccgactgctcagcgagaatcgtcgaaaaggacgagtagttcaggcggaaacgctggaagcagcgggccatgtgctattgctaacatcattaccggaagatgaatattcagcagagcaagtggctgattgttaccgtctgcgatggcaaattgaactggcttttaagcggctcaaaagtttgctgcacctggatgctttgcgtgcaaaggaacctgaactcgcgaaagcgtggatatttgctaatctactcgccgcatttttaattgacgacataatccagccatcgctggatttcccccccagaagtgccggatccgaaaagaagaactaactcgttgtggagaataacaaaaatggtcatctggagcttacaggtggccattcgtgggacagtatccctgacagcctacaaaacgcaattgaagaacgcgaggcatcgtcttaacgaggcaccgaggcgtcgcattcttcagatggttcaacccttaagttagcgcttatgggagtaatccccgcatatccggttgtcaggtcaggatggtaaggcacctgctttacactttcgcccgtggtcagtgatggctgcgggcgaatcgtaccagatgttgtcaattaatcgtgttggcacagcgttatgactatcttttcttttatctgccagtgcacagcaaacatctcattctcacgatgaatgatgacctgctgtttattccagctaattatctgatagtccagaaaacctgcatcagtttggatctcacttgccttaaatgcgctctctttggcggaaaatgccagtgtcagcgccagagaaaaggctaaaccgcagtctgcgagtcgctcgtgttccgctggtgtaataatgttgtctgtcaattctcttgcggtttgtacagaaaaaatttcttctatatcaatgccaatcggttgacgagataccacggctaatgccgtagtcccacagtggctaatactgccgtatacctccgcaggccagacaggttggcgtagctcgccgattgcgggcacacatttatagccatattcccgcaaagcataaacagcagcgatccgtccggctaaatgctctgttttacgtttacgtccagcgtgttgcagttgtgcgtagtgcggcagccagagtaaatcctgctcacaaaaattcgccggatcgaactcaacaaaatgcagcgtatgtccggcaaaggggagggaggtatgcgtagttttcatatcgaccatattcgagactgatgacaaacgcaaaactgcctgatgcgctacgcttatcaggcctacatggtcctgcaatatattgaattggcaagatttttgtaggccggataaggcgttcacgccgcatccggcatgaacgacgcgcactttgtcaacaatctgacgttagcatcagaagtgggtgtttacgctcatataccacgtacgtcccggctcgttataggtatacgccccggcaccggcgatatagttggcccctgccaaatcgcccgtggtctgggcattacccgcacgccacaaacgtttgtcgaacagattgtccacgccgccggtcagactgacattcttcgtcacatcccaggtcgcgctcaggccaacaatgctgtaaggactaatttctttggtttccggtccaaccgctggctgacctttatagttgtacttcttcggctgctgcttgccgtaccaggtgaaggtcgtttgcatcgacaaatcttcccgtgcctgccagctcagcgttgagttcaacgtatactccgggatgatcgacaaacggtcgcccgtggttttgttttcactcttcagcatataagtgatgttattggtccacatcaccgtttcgctaaccggtacgtttaacgatccttccagaccttcaaccaccgctttcggcacgttatcccactgatagagatcggtgccgactgcgttttgccctacagccacatagcccgcttcaatcttattgcgataatcgttacggaaccaggtgacgcccgccagccacccgtcgcgtttgaactccagaccaatctctttgttgatgctggtttctgctttcaggtcatcgttaccttgcagatagcagccgcccgcgctggcatagcaaccctgacctttactgtagagaatgtagttcgggttagtctggtacaggctcggcgctttataagcacgggcgatgcccattttcagcgtgaagtcatcgcctaaaccttgcgatatgttcagcgccgggctccagttattgccgacaatactgtgatgatcgaaacgcagccccggcgttacgatggtgctgtcagtcagctccatgttgttttcggcaaacagcgagaaaatttctgcttttgaatacgggctacggtcggtggtactcacgccatcaatagcgccaccggtattcgttccggtcagtgcctgggtgttggaacttaagtccttcatccgttgctgattccactccgtacccagcgtcagcgtctggttaacgaggaaatcaatcggcaggttaacttcgctgtgcagcatcacgtcatcaagatcgatatcgacgaaatcctgtgtcgctttttcgttaaatttcccttcggtaccgcccgccagaccttccggaatacgcgagttacgggtgtgttcgtactgcacccagttgctggtggtcacgccgttatcccagccaccgttccaggtcagcgcgtagttctggcgatacagacggttggtttcatcgccatatttcgagcgggtataggaatcggagttggtattctgggtgtcgcccgcatacaggttaccctggcggctgtaacctgcttccagttccagcgattgcaatggcgcgaaatcccagcgcaccacgccattaatatctttgttgattaccccttcgcgcccggctggtaacgtcgtggcatacgttccggcacgcgcggactgatggccctggttgatatcccacgcgtcagcctgggttttgtcgaggttgccatacaaacggaagctgaattcgtcgcccagcggaccggtcaggctaaagttagtgcgtttggtggcaccttcctctttatgttctggcgcattgaaatatgcgtcccaggagccgtgccactcgccgctgccttttttggtaatgatgttaaccacgccgcccgccgcgccgttgccataacgcgcagctgccggaccacgcagaacttcaatacgttcaatcatttcaggtggcacccaggaagtatcaccacgggtatcgcgctcgccacgccagccctgacgcaccgagttacggctgcttaccggcttgccgtcaatcaaaatcagcgtgttttccggacccataccgcgaatatcaatctgtcggttattcccacgctgaccactggtggagttaccggtcaggttaacgcctggcatggtacggatgatcttcgacacatcgcgggcaaccgggtttttgcggatttcatctgcggtgatggtcgaaacgccaggcgcctgtaagttctgctcggcggcggtaacgacaatagtatcgtcatgtgaaacaggagtatcggtcggctcttgtgcctgcgctaccccataaatccccagattgaccaacaaggccagggaatgaatcttcttgttcattgttttattcctgcatttttgccacgaattgcaactgtcgggcatggtcgtcatcaacacgacgcatcccgctaccgcgaaaacctttgatcctgaaagacacgcagtgcagttggttaattaatgtccgcgcttcccacggcgcgccattacgctattgcaaatgcaaatagttatcaataatattatcaatatatttctgcaatcaatgaaaaattgcacagtaaacatggggttatggtgtgacggcgttaaaagtaggaagtgagagctggtggcagtcgaaacatggcccggaatggcagcgtctgaatgacgaaatgtttgaggtcactttctggtggcgtgatccccaaggttctgaagaatactcgacgataaagcgcgtatgggtctacatcactggtgtgaccgatcaccatcagaacagccagccccagtcgatgcagcgaattgcaggcactaacgtctggcagtggacgacacaactcaatgccaactggcgcggcagctactgctttattcccaccgaacgcgatgacattttttctgtaccatcccccgatcgcctcgaattgcgcgaaggctggcgaaaactattaccccaggcgatagccgatccgctgaacctacaaagctggaaaggcgggcgagggcacgctgtttctgcactcgaaatgccgcaagcgcctctgcaaccgggatgggattgtccgcaagcgccagaaatacctgccaaagaaattatctggaaaagtgaacggttgaaaaagtcacggcgtgtatggatttttaccaccggcgatgcaacagcagaagaacgcccgctggcagttttgctcgatggcgaattttgggcgcaaagtatgcccgtctggccagtgctgacttcgctgacccatcgtcagcaacttcctcccgccgtgtatgtgttgatcgacgctatcgacaccacgcaccgcgcccacgaactgccgtgtaatgcggatttctggctcgcagtacagcaagagttattacccctggtgaaagctattgccccttttagcgatcgtgccgatcgcaccgtggttgccgggcagagttttggtgggctttccgcgctgtatgccggactgcactggcctgaacgctttggctgtgtattaagccagtcaggatcgtactggtggccgcatcggggcgggcagcaagagggcgtgttacttgaaaagctaaaagctggtgaagttagcgccgaaggtctgcgcattgtgctggaagcgggtattcgcgagccgatgatcatgcgggccaatcaggcgctgtatgcgcaattacaccccataaaagaatccattttctggcgtcaggttgacggcggacatgatgcgctttgttggcgcggtggcttgatgcaggggctaatcgacctctggcaaccacttttccatgacaggagttgaatatggcattcagtaatcccttcgatgatccgcagggagcgttttacatattgcgcaatgcgcaggggcaattcagtctgtggccgcaacaatgcgtcttaccggcaggctgggacattgtgtgtcagccgcagtcacaggcgtcctgccagcagtggctggaagcccactggcgtactctgacaccgacgaattttacccagttgcaggaggcacaatgagccagcatttacctttggtcgccgcacagcccggcatctggatggcagaaaaactgtcagaattaccctccgcctggagcgtggcgcattacgttgagttaaccggagaggttgattcgccattactggcccgcgcggtggttgccggactagcgcaagcagatacgctgcggatgcgttttacggaagataacggcgaagtctggcagtgggtcgatgatgcgctgacgttcgaactgccagaaattatcgacctacgaaccaacattgatccgcacggtactgcgcaggcattaatgcaggcggatttgcaacaagatctgcgcgtcgatagcggtaaaccactggtctttcatcagctgatacaggtggcggataaccgctggtactggtatcagcgttatcaccatttgctggtcgatggctttagtttcccggccattacccgccagatcgccaatatttactgcacatggctgcgtggcgaaccaacgcctgcttcgccatttacgcctttcgctgatgtagtggaagagtaccagcaataccgcgaaagcgaagcctggcagcgtgatgcggcattctgggcagaacagcgtcgtcaactgccgccgcccgcgtcactttctccggcacctttaccggggcgcagcgcctcggcagatattctgcgcctgaaactggaatttaccgacggggaattccgccagctggctacgcaactttcaggtgtgcagcgtaccgatttagcccttgcgctggcagccttgtggctggggcgattgtgcaatcgtatggactacgccgccggatttatctttatgcgtcgactgggctcggcggcgctgacggctaccggacccgtgctcaacgttttgccgttgggtattcacattgcggcgcaagaaacgctgccggaactggcaacccgactggcagcacaactgaaaaaaatgcgtcgtcatcaacgttacgatgccgaacaaattgtccgtgacagcgggcgagcggcaggtgatgaaccgctgtttggtccggtactcaatatcaaggtatttgattaccaactggatattcctgatgttcaggcgcaaacccataccctggcaaccggtccggttaatgaccttgaactggccctgttcccggatgtacacggtgatttgagtattgagatcctcgccaataaacagcgttacgatgagccaacgttaatccagcatgctgaacgcctgaaaatgctgattgcccagttcgccgcggatccggcgctgttgtgcggcgatgtcgatattatgctgccaggtgagtatgcgcagctggcgcagctcaacgccactcaggttgagattccagaaaccacgcttagcgcgctggtggcagaacaagcggcaaaaacaccggatgctccggcgctggcagatgcgcgttacctgttcagctatcgggaaatgcgcgagcaggtggtggcgctggcgaatctgctgcgtgagcgcggcgttaaaccaggggacagcgtggcggtggcactaccgcgctcggtctttttgaccctggcactccatgcgatagttgaagctggagcggcctggctaccgctggataccggctatccggacgatcgcctgaaaatgatgctggaagatgcgcgtccgtcgctgttaattaccaccgacgatcaactgccgcgctttagcgatgttcccaatttaacaagcctttgctataacgccccgcttacaccgcagggcagtgcgccgctgcaactttcacaaccgcatcacacggcttatatcatctttacctctggctccaccggcaggccgaaaggggtaatggtcgggcagacggctatcgtcaaccgcctgctttggatgcaaaatcattatccgcttacaggcgaagatgtcgttgcccaaaaaacgccgtgcagttttgatgtctcggtgtgggagtttttctggccgtttatcgcaggggcaaaactggtgatggctgaaccggaagcgcaccgcgacccgctcgctatgcagcaattctttgccgaatatggcgtaacgaccacgcactttgtgccgtcgatgctggcggcatttgttgcctcgctgacgccgcaaaccgctcgccagagttgcgcgacgttgaaacaggttttctgtagtggtgaggccttaccggctgatttatgccgcgaatggcaacagttaactggcgcgccgttgcataatctatatggcccgacggaagcggcggtagatgtcagctggtatccggcttttggcgaggaactggcacaggtgcgcggcagcagtgtgccgattggttatccggtatggaatacgggtctgcgtattcttgatgcgatgatgcatccggtgccgccgggtgtggcgggtgatctctatctcactggcattcaactggcgcagggctatctcggacgccccgatctgaccgccagccgctttattgccgatccttttgccccaggtgaacggatgtaccgtaccggagacgttgcccgctggctggataacggcgcggtggagtacctcgggcgcagtgatgatcagctaaaaattcgcgggcagcgtatcgaactgggcgaaatcgatcgcgtgatgcaggcgctgccggatgtcgaacaagccgttacccacgcctgtgtgattaaccaggcggctgccaccggtggtgatgcgcgtcaattggtgggctatctggtgtcgcaatcgggcctgccgttggataccagcgcattgcaggcgcagcttcgtgaaacattgccaccacatatggtaccggtggttctgctgcaacttccacagttaccacttagcgccaacggcaagctggatcgcaaagccttaccgttgcctgaactgaaggcacaagcgccagggcgtgcgccgaaagcgggcagtgaaacgattatcgccgcggcattctcgtcgttgctggggtgtgacgtgcaggatgccgatgctgatttcttcgcgcttggcggtcattcgctactggcaatgaaactggcagcgcagttaagtcggcaggttgcccgccaggtgacgccggggcaagtgatggtcgcgtcaactgtcgccaaactggcaacgattattgatgctgaagaagacagcacccggcgtatgggattcgaaaccattctgccgttgcgtgaaggtaatggcccgacgctgttttgtttccatcctgcgtccggttttgcctggcagttcagcgtgctctcgcgttatctcgatccacaatggtcgattatcggcattcagtcaccgcgccccaatggccccatgcagacggcggcaaacctggatgaagtctgcgaagcgcatctggcaacgttacttgaacaacaaccgcatggcccttattacctgctggggtattcccttggcggtacgctggcgcagggtattgcggcgcgactgcgtgcccgtggcgaacaggtggcatttcttggcttgctggatacctggccgccagaaacgcaaaactggcaggaaaaagaagctaatggtctggacccggaagtgctggcggagattaaccgcgaacgcgaggccttcctggcagcacagcagggaagtacttcaacggagttgtttaccaccattgaaggcaactacgctgatgctgtgcgcctgctgacgactgctcatagcgtaccgtttgacggtaaagcgacgctgtttgttgctgaacgcacacttcaggaaggtatgagtcccgaacgcgcctggtcgccgtggatagcggagctggatatctatcgtcaggattgtgcgcatgtggatattatctctccagggacgtttgaaaaaattgggccgattattcgcgcaacgctaaacaggtaaattaatattatttataaacccataattacagaaaataattatgggttttttatttgtttgatttataggtttgatgaatatttctcttaaatagagtgaatgttgcattcagtggaaggaatttacaaacttcagcttcggataattatcaccaactggtaaagtgagcgccgtggagatttccccctattggactcattttcaggttataccccatgtcatcactgaatattaaacagggaagtgacgctcattttcccgattatcctctggcgtcgcccagtaataatgaaattgatttacttaatctaatctcagttttatggcgggccaaaaaaacggtcatggcggtcgtttttgcgtttgcctgcgcaggcttgctgatctctttcatcctgccgcaaaaatggaccagcgcggcggttgtcacgcctccagaacctgttcagtggcaagagttggagaaatcattcactaagcttcgtgtgctggatctggatatcaaaattgatcgtacagaagcatttaacctgtttatcaagaagtttcagtcggttagcttgctggaagagtacctgcgttcatcaccttatgtgatggaccaattaaaagaggcgaaaatcgacgaactggatttgcatcgcgcaattgtcgcattgagcgaaaaaatgaaagcggttgatgacaatgccagtaagaaaaaagatgaaccgtcactgtatacctcctggacgctaagttttaccgcgccaaccagtgaagaggcgcagaccgttttgagcgggtatatcgattatatctctacgttggtggtgaaagagtcgctagaaaacgtccgtaataaactggagatcaaaacccagtttgaaaaagaaaaactggctcaggatcgcattaaaacgaaaaatcaacttgatgcaaacattcagcgcctcaattattcactcgacattgccaacgcggcaggaattaaaaagcccgtttacagtaatggtcaggccgttaaagatgaccccgatttttctatttctctcggtgcagacggtattgaacgcaaactggaaatagaaaaagcggtcactgacgttgcggaactgaacggtgaattacgtaatcggcagtatcttgtcgagcaattaacaaaagcacatgtcaacgatgtgaattttacgccgtttaaatatcagttaagcccgtcattgccagtgaaaaaagacggtccgggtaaggcgattattgtgatcctttccgcgttgatcggcgggatggtggcttgtggtggcgtgctgttgcgctatgcgatggcatccagaaaacaggatgccatgatggcagaccacttagtttaactatttgcggttgaaggtgccgttcgtccgagcggcaccacaagcggcgttccggcaactggatcgtcaatgatcatgcagcgcagaccataaatgcgctcaatcagttcagcagtgacaatctccttcggcgctccctgagcaacaattttcccttcccgcaatgcaatcaaatggctggcgtaacgacaggcctgattaagatcgtgcagcaccgccgccagggtatagcctttttcgcggttcagttcgcttaacaactccagcaaatcaatctgatgactgatatccagccaggtcgtgggttcgtcgagcagcataattgccgtttcctgggccagcaccatcgcgatccacgctcgctggcgttgtccgccagaaagggtatccacgctttgatctgccagatgagttattcccgtggcctgcattgctttcgttaccgcttcttcatcctctttgcgccagcgggtaaacagcggttgatgcggataacgtccacgcgccaccagctcctgcacggtgatatcgcccggcgtggtagcattttgcgccaacagaccaatccggcgtgcaacctctttactggcgtaatgttgaatgtgctcgccatccagccagacatgcccatgagcaggcgtcatcaggcggcttaaggtacgcagtaacgtggatttaccgcagccatttggcccgataattgccgtgaagtgaccatcaggtatttctacagtcagattttccgcaacggtatatttgccatatcccagggttaactgttcgccgcgcaaacgggctactgattcggtcattttttgcgagactcctgaattaacaagacgataaggtaaataccgccgaggctgacggtaacgacgccaaccggaagttgatacggcataaacagttgttgggcgcagagatcggccgccagcagtaacagcgccccgcatagcgccgcctgggttagcccccagcgagcggtgccgctaatgcgtcgggcaatgtgcggtgcgactaaagcaataaaggaaatcggcccggcaagcgctgttgccgcagcggtaagcaccactgcaaccagcatcattaacagacgcgaacgttcgacgctgacgcccagcgcacacgcggtatcatcgcccatttccagcaagcgcatccggcgtaccagtaaggcggcggcaatgagcatcaatataatgatgggtgcggaaggcgaggtttttgcccacgtcaggccgttgagcgatccggcattccacaaacctgctgttagcgccgtttctaaagacgctttcagcaacagccaggtattaaaggccaccagcatggcgcgaacgccgataccgataataatcaaccgaaaggtgtcgatgccgttgcgccaggcgagcagccagaccagcagcgaagtgacaatgccgcccaccattgctgacagcgcgatagccgtcaggtcctgaccaaacagcaccatcgccaccagcacgccgctccacgccccggtgttaaagcccattacgtcagggctgccgagcgggttacgcatcagcgactgaaaaatcgcgccactgacgcccagtgctgcgccaatcaacagcgccatcagcacgcgtggtaaacgccattcggtgaccaccatcgtcatactgcgcggcgcatcgcccatcagcgcggcgaatacctgcgaggtttccagcgtgacggcaccgctgcgtaatccccagatacctgcaaccacacaggcggaaaccagcagcaaacaggtgatgagtaatcggcgagagacgtaaatcatgcaccacctcgcgttttacgtcgcacgaggaagatcagcaccggtgcaccaataaacgcactgaccacagaaacgcgcagttcgccgggcacaatcacccgcccgatgatatcggcaaacagcagcagggcaggggtagcaagtagcgtgacgggcagcgaccagcgatgatcggcacccaccagccaacgcgccatatgcggcatcatcaggccaataaaggcaatcgggccaactattgccgtcgcactaccacaaagcacggtaatcgccagcagaccaatcaactgtgtgcgcgccacgcgactgcccagcgccgtcgcggtgtcgctgccgaggctcaaactgttcagcgcgcgactcagtaatagcgcagttgctccggcgatcagcaccgggatcagcaccacttttaaggtatgtagattgcgaatatccagcgaaccggcttgccagaaacgcaactgatcgtagacgtcaggattaagcagggcgatgccgctggtcagtccttccagcaccgccgccagcgccacgcccgccagggttaaacgcaccggacttaactgcccgccgccctgactgccggtaaaggcaacaatcaatgaggccaccagcgccccggcgaaggccatcgccagttgttcctgcgcggaagagtaaccaaacagcgccgcacccagcacaatggcaaagctggctccggcgttcacgccaagcaagccggggtcggcaagtgggtttcgggtgagggtttgcattaacgccccggcaaggccaagcgcgccgcctgccagtaaaccggcaagggtacgcggcagccgcgcgtcgagcacgatggtgcagtcggcgctctggcaggtgccggagaaggcctccagcactacggaagcggggagtgattttgccccaatgagcaggcttaatgccgtcgcgataatcagtaataacagcaatccgggcacggcaatggcgcgtgtcacggcaacagaaccagacatacgaacttccatgataatgaaattaattatcgttatcgatcttatttggatatgttagcatgtgcagcctaagaataggtatttaaaatatttgatggcaaggcattgtaatgaataaacaatcctggctgcttaacctcagcctgttgaaaacgcacccggcgtttcgcgcagtattcctcgctcgtttcatctcaattgtgtctctgggtttgctcggcgtcgcggtgccggtgcagatccagatgatgacacattccacctggcaggtggggctttcggtgacgctgaccggcggcgcgatgtttgttggcctgatggtcggcggtgtgctggcggatcgctatgagcgcaaaaaagtgattttgctggcgcgcggcacctgtggcattggcttcattggactgtgccttaatgcactgctgccggagccgtcattgctggcaatctatttacttggtttatgggatggttttttcgcatcgcttggcgttacggcgctattggcggcgacaccagcactggtagggcgtgaaaacttaatgcaggccggggcgatcaccatgttgaccgtgcgtctggggtcggtgatttcgcccatgattggcggtttattgctggcgaccggtggcgtagcctggaactacgggctggcggcggcgggcacgtttattaccttgctaccgttgttaagccttccggcgttgccaccgccaccgcagccgcgtgagcatccgttgaaatcattactggcaggatttcgttttctgcttgccagcccgctggtgggcgggattgcgctgctgggtggtttattgacgatggcgagcgcggtgcgggtactgtatccggcgctggctgacaactggcagatgtcagcggcacagattggttttctctacgcggcgatcccgctcggcgcggctattggtgcgttaaccagcgggaagctggcacatagtgcgcgaccagggttattgatgctgctctccacgctgggatcgttcctcgccattggtctgtttggcctgatgccgatgtggattttaggcgtggtttgtctggcgctgttcggctggttgagtgcggtcagctcgttgctgcaatacacaatgctgcaaacgcaaaccccggaagcgatgttagggcggattaacggtttgtggacggcgcagaacgtgacgggcgatgccataggcgcggcgctgctgggtggtttgggcgcgatgatgacaccggttgcttccgcaagcgcgagcggttttggtttgttgattatcggcgtgttgttattgctggtgctggtggagttgcgacattttcgccagacgccgccgcaggtgacagcgtccgacagttaatgcttaaaacagcgccttaagcctatccagcacttgcatggcgctgtagtaatccagacggaacgtctcggttcccagcgcataaacctgcttgttttgtactgcaggcaggtgcgcgagcagcggattagcataaatagcatcggcatctttctgatcaccggcgaacaggaatagtgactcgccatttaaccctgcagccagattttccccaccaagctgaatgatgtcatggcgtttaccctgactttggctggcatttaaccctgcgggtaacttcgccagcgtaaagccgagttgttccagcatctgcccttgtgctgattctggcgtccagagattggcactgtgtgcagcggcagtatagacaatggcagtgaccggctgcggcggtaatttgatttgctctttcgccgccgccagttgcttatcaaactgcgcaatccgctctgccgcttgtttctcatgcccggtaatttcgccaagttgcgttaacagcgactgccagcttttgtcgtcgtaattgatgattaatgtcggggcgatggtggaaagctgatcatacagtgccagcgccgaatccccgccggttgcgctaattaaaatcagatccggcatttgcgcggcaacggcttcggcgctcggttcgccgatatagagccgttgcagtttgcgttctttcgccaccttgctccactggcgtaaaaagccctggtcatccgcgacgcggttattcggcgtggtcgcgccgctggcgatcaccggagcatcaatcgccagcagtgagccggtcagggtgacgctggtggaaacaatacgctgcggctggctttccagtgtatgtgtgccacggctgtcagtaatctgacgcggccagtcagcggcctgaactgcggctattcctgaaagcaaaagtcctgttaatagaagggcgttgcggtagagcggggcgagtctcacaaatcagcttcctgttattaataaggttaagggcgtaatgacaaattcgacaaagcgcacaatccgtcccctcgcccctttggggagagggttagggtgaggggaacagccagcactggtgcgaacattaaccctcaccccagccctcaccctggaagggagagggggcagaacggcgcaggacatcacattgcgcttatgcgaatccatcaataatgcttctcattttcattgtaaccacaaccagatgcaaccccgagttgcagattgcgttacctcaagagttgacatagtgcgcgtttgcttttaggttagcgaccgaaaatataaatgataatcattattaaagcctttatcattttgtggaggatgatatggatacgtcactggctgaggaagtacagcagaccatggcaacacttgcgcccaatcgctttttctttatgtcgccgtaccgcagttttacgacgtcaggatgtttcgcccgcttcgatgaaccggctgtgaacggggattcgcccgacagtcccttccagcaaaaactcgccgcgctgtttgccgatgccaaagcgcagggcatcaaaaatccggtgatggtcggggcgattcccttcgatccacgtcagccttcgtcgctgtatattcctgaatcctggcagtcgttctcccgtcaggaaaaacaagcttccgcacgccgtttcacccgcagccagtcgctgaatgtggtggaacgccaggcaattccggagcaaaccacgtttgaacagatggttgcccgcgccgccgcacttaccgccacgccgcaggtcgacaaagtggtgttgtcacggttgattgatatcaccactgacgccgccattgatagtggcgtattgctggaacggttgattgcgcaaaacccggttagttacaacttccatgttccgctggctgatggtggcgtcctgctgggggccagcccggaactgctgctacgtaaagacggcgagcgttttagctccattccgttagccggttccgcgcgtcgtcagccggatgaagtgctcgatcgcgaagcaggtaatcgtctgctggcgtcagaaaaagatcgccatgaacatgaactggtgactcaggcgatgaaagaggtactgcgcgaacgcagtagtgagttacacgttccttcttctccacagctgatcaccacgccgacgctgtggcatctcgcaactccctttgaaggtaaagcgaattcgcaagaaaacgcactgactctggcctgtctgctgcatccgacccccgcgctgagcggtttcccgcatcaggccgcgacccaggttattgctgaactggaaccgttcgaccgcgaactgtttggcggcattgtgggttggtgtgacagcgaaggtaacggcgaatgggtggtgaccatccgctgcgcgaagctgcgggaaaatcaggtgcgtctgtttgccggagcggggattgtgcctgcgtcgtcaccgttgggtgagtggcgcgaaacaggcgtcaaactttctaccatgttgaacgtttttggattgcattaaggagcgaggatgagcattccattcacccgctggccggaagagtttgcccgtcgctatcgggaaaaaggctactggcaggatttgccgctgaccgacattctgacgcgacatgctgcgagtgacagcatcgcggttatcgacggcgagcgacagttgagttatcgggagctgaatcaggcggcggataacctcgcgtgtagtttacgccgtcagggcattaaacctggtgaaaccgcgctggtacaactgggtaacgtcgctgaattgtatattacctttttcgcgctgctgaaactgggcgttgcgccggtgctggcgttgttcagccatcagcgtagtgaactgaacgcctatgccagccagattgaacccgcattgctgattgccgatcgccaacatgcgctgtttagcggggatgatttcctcaatactttcgtcacagaacattcctccattcgcgtggtgcaactgctcaacgacagcggtgagcataacttgcaggatgcgattaaccatccggctgaggattttactgccacgccatcacctgctgatgaagtggcctatttccagctttccggtggcaccaccggcacaccgaaactgatcccgcgcactcataacgactactactacagcgtgcgtcgtagcgtcgagatttgtcagttcacacaacagacacgctacctgtgcgcgatcccggcggctcataactacgccatgagttcgccaggatcgctgggcgtctttcttgccggaggaacggttgttctggcggccgatcccagcgccacgctctgtttcccattgattgaaaaacatcaggttaacgttaccgcgctggtgccacccgcagtcagcctgtggttgcaggcgctgatcgaaggcgaaagccgggcgcagcttgcctcgctgaaactgttacaggtcggcggcgcacgtctttctgccacccttgcggcgcgtattcccgctgagattggctgtcagttgcagcaggtgtttggcatggcggaagggctggtgaactacacccgacttgatgatagcgcggagaaaattatccatacccagggttacccaatgtgtccggatgacgaagtatgggttgccgatgccgaaggaaatccactgccgcaaggggaagtcggacgcctgatgacgcgcgggccgtacaccttccgcggctattacaaaagtccacagcacaatgccagcgcctttgatgccaacggtttttactgttccggcgatctgatctctattgatccagagggttacatcaccgtgcaggggcgcgagaaagatcagattaaccgtggcggcgagaagatcgctgccgaagagatcgaaaacctgctgctgcgccacccggcggtgatctacgccgcactggtgagcatggaagatgagctgatgggcgaaaaaagctgcgcttatctggtggtaaaagagccgctgcgcgcggtgcaggtgcgtcgtttcctgcgtgaacagggtattgccgaatttaaattaccggatcgcgtggagtgtgtggattcacttccgctgacggcggtcgggaaagtcgataaaaaacaattacgtcagtggctggcgtcacgcgcatcagcctgaaggagagaacacgatggctattccaaaattacaggcttacgcactgccggagtctcacgatattccgcagaataaagttgactgggcctttgaaccgcaacgtgccgcgttgttaatccatgatatgcaggactattttgtcagcttctggggcgagaactgcccgatgatggagcaggtgatcgcgaatattgctgcgctgcgcgactactgcaaacagcacaatatcccggtttattacaccgcccagccgaaagagcagagcgatgaagatcgggcgctgttgaatgatatgtgggggccgggcctgacccgctcgccggaacagcaaaaggtggtggatcgcctgacgccagatgccgacgacacggtgctggtgaagtggcgctacagcgcgtttcatcgttctccgctggagcaaatgctgaaagagagtggacgtaaccagctgattattaccggggtatatgcccacattggctgtatgaccaccgcaaccgacgcatttatgcgcgatattaaaccgtttatggtggcggatgcgctggccgatttcagccgtgacgagcatttgatgtcgctgaaatatgtggccggacgttctggccgggtggtgatgactgaagaattactgccagcacctatccccgccagcaaagcggcgctgcgtgaggtgatcctgccgttgctggacgagtccgatgaaccgttcgatgacgacaacctgatcgactacggtctggattcggtgcgcatgatggcgctggcggcgcgctggcgcaaagtgcatggtgatatcgactttgtcatgctggcgaaaaacccgaccatcgacgcctggtggaagctactctcccgcgaggtgaaataatggatttcagcggtaaaaatgtctgggtaaccggcgcaggtaaaggtatcggctacgccacggcgctggcgtttgttgaggcgggagcgaaagttacaggttttgatcaagcgttcactcaggagcaatatccctttgcgaccgaagtgatggatgttgccgacgctgcgcaggtcgcgcaagtgtgtcagcgactgttagctgaaacggagcgactggacgcgctggtcaatgcggcgggaattttacgcatgggcgcgaccgatcagctcagtaaagaggactggcagcagacttttgcggttaacgtcggcggtgcgtttaacctgttccagcaaaccatgaaccagtttcgccgtcagcggggcggggcgattgtcactgtggcgtccgacgccgcgcacacgccgcgtattggcatgagtgcttatggcgcatcgaaagcggcgctgaaaagcctggcgttgagcgtcgggctggaactggcgggtagcggcgtgcgctgtaatgtggtttcgcctggctccaccgacaccgatatgcaacgcacgctgtgggtgagcgatgacgccgaagaacagcgtattcgcggctttggcgagcagtttaaactcggcattccgctggggaaaatcgcccgtccacaagagatcgccaacacgattttgttcctcgcctctgacctcgccagccatattaccctacaggatattgtggtcgatggcggctcaacgctgggggcataagcatgatctggaaacgccatttaacgctcgacgaactgaacgccaccagcgataacacaatggtggcgcatctgggaattgtgtatacccgtctgggcgatgatgtgctggaagccgaaatgccggttgatacccgtactcatcagccgttcggtttactacatggcggcgcgtcggcggcgctggcggaaacgctgggatcgatggccggatttatgatgacccgcgacggacagtgtgtggtaggcacagaacttaatgcaacacaccatcgcccggtgtctgagggaaaggtacgcggcgtctgccagccgctgcatcttggtcggcaaaatcagagctgggaaatcgtcgttttcgatgaacaggggcggcgttgctgcacttgtcggctgggtacggcagttttgggatgaacccgacagaattagatgagattgcaggaaaactcggttaacggagtgatcgagttaacattgttaagttaaatattggtttcaactccgatttacatggttgctgtgttgttaaattgtacaaagatgttatagaaacaaaatgtaacatctctatggacacgcacacggataacaactatgaacaaatcagggaaatacctcgtctggacagtgctctctgtaatgggagcatttgctctgggatacattgctttaaatcgtggggaacagatcaacgcgctgtggattgtggtggcgtcggtctgtatctatctgatcgcttaccgtttttatgggctgtatatcgccaaaaatgtgctggcggttgacccgacgcgtatgacgccagcggtgcgccataacgacgggctggactatgtgccgacggacaagaaagtgctgttcggtcaccattttgcggccattgccggagcaggtccgctggtggggccggtactggcggcgcaaatgggctacctgccggggatgatctggctgctcgctggggtggttctcgccggtgcggtgcaggatttcatggtgctgtttgtttctacgcgccgtgacggtcgctcgctgggtgagctggtcaaagaagagatggggccaaccgccggggtgattgcgctggtggcctgctttatgatcatggtcattatccttgcagtgctggcgatgatcgtggtgaaagccctgactcatagcccgtggggaacatataccgttgcgttcaccattccgctggcgctgtttatggggatctacctgcgctatctgcgtccggggcgtattggcgaagtgtcggtcatcggtctggtattcctgattttcgccattatctctggcggctgggtggcagaaagtccgacctgggcaccgtactttgactttaccggcgtgcagttgacctggatgctggtgggttacggttttgtggcggcggtgctgccggtgtggttactgctggccccgcgtgactacctctctaccttcctgaaaatcgggactatcgtcggtctggcggtaggcattttgattatgcgcccgacgctgaccatgcctgcgctgaccaaatttgtcgatggcactggcccggtatggaccggtaacctgttcccgttcctgtttatcaccatcgcctgtggcgcggtgtctggcttccatgcgctgatctcttctgggaccacgccgaagatgctggcgaacgaagggcaggcgtgctttatcggctacggtgggatgttaatggaatccttcgtggcgattatggcgctggtttccgcctgtatcatcgatccgggcgtgtattttgccatgaacagcccgatggcggtgctggctccggcagggacggcggatgtggtcgcttctgccgcgcaggtggtgagtagctggggctttagcattacaccagatacgctaaaccagattgccagcgaagtgggtgaacagtcgatcatttcccgtgcgggcggtgcgccgacgctggcggtggggatggcctacattctgcacggcgcgctgggcggcatgatggatgtggcgttctggtatcacttcgccattttgtttgaagcactgtttattctgacggcggtggatgcaggtacgcgtgctgcgcgctttatgttgcaggatctgctgggcgtggtgtctcctggcctgaagcggaccgattcactgcctgctaacctgctggcaacagcgctgtgcgtactggcgtggggctacttcctccatcagggcgtggtcgatccgctgggcggcattaacactctgtggccgctgtttggtattgccaaccagatgctggcagggatggcgctgatgctctgtgccgtggtgttgttcaagatgaaacgtcaacgttacgcctgggtggcgctggtaccaacggcctggctgctgatttgtaccctgaccgcaggctggcagaaagcgtttagcccggatgcgaaagtcggcttcctggccattgctaataagttccaggcaatgatcgacagcggcaatattccgtcgcagtatactgagtcacagctggcgcaactggtgttcaacaaccgtctggatgccgggttaaccatcttctttatggtggtcgtggtggttctggcactgttctcgattaagacggcacttgcggcattgaaagatccgaagccaacggcgaaagaaacgccgtatgaaccaatgccggaaaatgtcgaggagatcgtggcgcaggcaaaaggcgcacactaaagtcagagtgagggggggatgttggcgaatgttggcttagtgcccagggttccctctcaccctaaccctctccccggtggggcgaggggactgaccgagcgcgttgatagcatttgtaggccggataaggcgttcacgccgcatccggcactctttcagcaacatggttagcggaggccaagatgtttgattcactggcaaaagccggaaaatatttaggtcaggcggcgaagctgatgattggtatgcctgattacgacaactatgtcgaacatatgcgggttaaccatcccgatcaaacgccgatgacctacgaagagtttttccgtgagcggcaggacgcgcgctacggtggaaaaggcggcgcgcgctgctgctaaatttgtacgtcaggctttaaacgattccacttttttgaacgctgcacgcaacgtatctggtgtcagcgtgactggcaggtaatgaatggactccaccggacgcagggtgtgggcaatcactttgtcgatctccgcctgattattgatatccacttccagctccgccagtgtagtcggcagatgaaaacgctgatacgctccagttaattgcgccagcacatcatcctgacccagcaaggcgctttgcaccagaattccgtaggcgactttggtgccgtggagaaacttctcggtttgcggcagcacggtcagaccgttatgcacggcatgagctgccgccacacgcgtaaaacgatcgcccagaccaccaaccatcccaccaccagcaataatagcatccaccacatcgcaaaatgattgcgttaactgttgattttgctgatcgctcagcgcctgttcgctactgtttaacaagacgtcgcgaatggcttgcgcattattgatccccagtcgcacggttagcggcaacgtttctggttgcggagccagcaccaccgcttcataccatttcgccagcgtgtcaccgatccccgccagcagatattgttgcggtgcattgaggataatctccggttccaccagcaccataaaattggcgtcgtcgaaaatctcataatgcagcgcctgtccggcatcattataccagacggagagcggtgtccaggcggcgcaggtggcggcgatcgtcggaacggcaacaaacggcagaccgagacggcgggcgagggctttcgcggtgtcgagcagtgcaccgccaccgacgccaatcaccacgctgcggtcgtcaccggactcagccgccagttgttgtacatcgctttcgctgcaatgaccgcgaaacaaaatatgctttgcccctggcagtccaaacgctggcggaagtttggtttgcgccgcagcaatggcgcgtttgccgtagatccacaccgcgcgagaaagttgttcatcagtgaaaaaatcgtgcaggtgattgaaacttcctggatgtgaaaagtagttagccgggccgacgaccacgcggataggattgtgaggcatgttgtgttgtccttattgttttatttagacatctaaacgtcttgattgccaaatactagcatcgtgttatagtgccttcaacacgcaacttcgtcaggtacaataaaaatgacaaataaccctctgattccacaaagcaaacttccacaacttggcaccactattttcacccagatgagcgcgctggcgcagcaacaccaggcgattaacctgtcgcaaggctttcctgattttgatggtccgcgctatttacaggagcggctggcgcaccacgttgcacagggggcaaaccaatacgcgcccatgaccggcgtgcaggccttgcgcgaggcgattgctcagaaaacggaacgtttgtatggctatcaaccagatgccgatagcgatatcaccgtaacggcaggggcgacggaagcgttatacgcggcgattaccgcactggtgcgcaatggcgatgaagtgatttgttttgatcccagctatgacagttacgcccccgccatcgcgctttctgggggaatagtgaagcgtatggcactgcaaccaccgcattttcgcgttgactggcaggaatttgccgcattattaagcgagcgcaccagactggtgatcctcaacactccgcataaccccagtgcaactgtctggcagcaggctgatttcgccgctttgtggcaggcgatcgccgggcacgagatttttgtcattagcgatgaagtctacgagcacatcaacttttcacaacagggccatgccagtgtgctggcgcatccgcagctgcgtgagcgggcagtggcggtttcttcatttggcaagacctatcatatgaccggctggaaagtgggttattgtgttgcgccagcgcccatcagcgccgaaattcgcaaggtacatcagtatctgaccttttcggtgaataccccggcacagctggcgcttgctgatatgctacgtgcagaacctgagcattatcttgcgttaccggacttttatcgccagaagcgcgatattctggtgaatgctttaaatgaaagccggctggagattttaccgtgtgaaggtacatactttttgctggtggattacagcgcggtttctaccctggatgatgttgagttttgccagtggctgacgcaggagcacggcgtagcggcgattccgctgtcggtgttttgcgccgatcccttcccacataaactgattcgtctctgttttgccaagaaggaatcgacgttgctggcagcagctgaacgcctgcgccagctttagctatttaaccgtccaggcgcgggaatattgacggtcggcaaacaactcttgcaggccgttaatttgcttcaggcgcagcacttcgtcgctgtccattcccagctctttgccaattttattatcgtcccatcccaactggctaagttcacggacgatttccgacatggcggtgatttgatggcgtccacgagcgcgattatgacgaatagtcgcggcgatgcgttgattacgcgtaccttccagacaggtcaccggcaaataaccttttaagcgtaattttaatgatgatgagcctttaccaatttcatggcggtgaaaaccatccacgatttccatggcatttttatccgtatgtgtgaccacaatgggttgggtaaaaccatctatttcaatggatttttgcagcagttttttttcgggtggtgccacgttgtttgggttgtaatcattaggcataagttggctgtttttaacccacagaacgcaatccactggctcttcacgaaaggggctaacctgatggatcgccatgcggatttcattaatcgctttgatgcgatcatcttccggcaagctggcgagaaattgcgttaaatcctgcgttaatcgttgttgcatagtatcccccattcctgacgttttccttttatccgttcgttataacgctgatagttcttcgattttgtggggctaaatgataatgcccgacaccagtaatcgttattgagtaaaactttgcatatccgccgccaggaggggatatctttcgcgccaatgtccccttgctgggtttgtggaacctcgatgccttttttctgataccagtgcaaataaatggcgattttattgcggtaatgctcagctgttttttccggcatgctattgagcagcaataatgcatattcttgccagtctaaatgttctggcttgaggattttccgatgcccatagaaatgattgtcatgtccggcgtaaatgccgccactttttaccccgctgactcgtgcgcacatagcagcccagcgatccggttcgataacgtgatagagccataatccttgtcgttgctccgggccaaaaggttcgcaaattcgcatatgacgcagaggaacgcctgcctgatacattaggttatacagtgggttgcagagactttgatgatttgcataccaggtccagatatcagccactttccagtcgtaaatggggtaaatgtaccagctatgaccgcctggtgcggccgtagtccagggtttatcgtcggcaaaacgttgtttatttaaactggcgatggcgacaaaacggttgtaggactcatccgcacggatgccgatcatcatcgccgccggacgtttttgtgaaaaccattcggcaaactcacgtacaaattgttcgaaggtcatgcctggctggtaaaagcagaaaaagtcagggtcggttatcgcatcttggggaggttgacgtacccattcgacatcaggttcccagcactgccattcgggttggtattgtgaaagggaattttgcgtcgtaagcgggagcgcaacccagtaaaactcttcgatgacatcggtgtacaactcgcgcagggactgaacatagttaatggtgcaagagaattgcgcctcccagtcgataaacaaaacgcagatttttttgcccatttgtcgggcaagttcggctgtcagatgcagcattaaaccagagtctttgccgccagaaaatgagacacaaacgcggggtagggtgttgagtgtccaggtaatacgctctcgtgcagcttccagaatattgagcggaagaggaattttataaatagacatctgaagacgctctctgaacgttacagggtgatcagtgagataagtctgttaattataaagtaaacactgtaaagcagagtgttttatttttcattcgcgctgtgaataaatagatgaaagttatagtagctgtctgtagttatatatcaaaaactctcatttagacggtcaataaatcgggagaacaccaaattatttaaagaagatttattataggaaatgtaaagctttattgaaggtaacggatgttctagttttatctcttttaagttaagaaagtcacggtaggaattataaagttcataggggactattcccagtaaatctgtaactgcaatgctattaatgattgtcagcaaagaggaaccacgaaatgagattttgcgattcataaatctctcgtctatttccatttgaatatcatcaacccctgctgatttagatattaattgggtgaactcttctgccataatttgttcataagtgctattgtcagtaattcgtggatgcctattactacaaattagagtattgcgaatcgtatgcaatggcatgcaaatgacggaacggctgatcactggcatttgggtgatcaccagatcggctttgcggtgaaccaacagttcttcagcattctctgctgacatgaggatatcatggcactcaatctcgacagaggaatcttgccgtaggcagcggatcagcatactattattagagcaagaaatgagctgagggccgtagataataaagtttttctttagttcggacttattgactatattaattgtttgttcaaggcctctgagatttttctcaagatggtgatgcagatttaaccctgttgtcgtcggcgcgataccttttcctgagcgaatgaataaagggtcattaaattgcgcacgtaagcgttgtaacgactggctcacggctgatggggtgatatatagtgattcagcagctttgctaatgcttaaatgctggtaaatacactcaaatatgacaagaagatttaagtcgaactttttcaagtcgtagagattggccatacactactccggttatatttttcttccatgatatattcacttaatcaatgttttttgcgtatatatttttattgattatgtttttttgcttaactcaggattaagtttttctaaaatagcacagccacttagggcagagcgagcaattcatgcttttttaggatggttgaaaagcagggatatagttcaaccatccatgaattaccttttatttattccccataatgatattaagcgttttctgatcgggcaaccccacggcctgttgtagcgtattttccttactcatgtaatagatagccggcgtgacatttgcccccagatcgtccatcagtttctcattgtcacttaacactttcatttgctctgtacttacgtttgcaggcacgtttagcttaagcttgccaccagaggcttcatattgttgccaggtttttgcgggatctttggaggcaagaattgccgctgctgtcgccgggctttctggcttgataaccccaaccaacaatgttcttaattgcactttgccagaatctacccacgggcgcgcctgctgccagaactgtttacaatatgggcagaacggatcggcgaagacgtagacaatgaccggcgcatcttttttaccgtcgaggagccagtgggattgttccatccgttgccacatttcgcgtccggctggtgcgtaaatttctttttcgataagtgtgttactcaggttttcacctttctcgttgtacatgtaaccagagatagcgtgcttaccatctggagtcaggtagatggtgacgcccatatcctgatactttccgagataacctttcattcctccgggggcatcgaatgttttgatgattgtaatgccctgtttttcaatcgcttttactggagcaggaagttcctctgcgaaggcgattgcaggaagcagagccagtaaaagtatcttttttaacattaatttgtccttttcagtcagtgcaaaagtcgagtaaaaggcataacctatcactgtcataggtaagagcttagatcaggtgattgccctttgtttatgagggtgttgtaatccatgtcgttgttgcatttgtaagggcaacacctcagcctgcaggcaggcactgaagataccaaagggtagttcagattacacggtcacctggaaagggggccattttactttttatcgccgctggcggtgcaaagttcacaaagttgtcttacgaaggttgtaaggtaaaacttatcgatttgataatggaaacgcattagccgaatcggcaaaaattggttaccttacatctcatcgaaaacacggaggaagtatagatgtccttgattaacaccaaaattaaaccttttaaaaaccaggcattcaaaaacggcgaattcatcgaaatcaccgaaaaagataccgaaggccgctggagcgtcttcttcttctacccggctgactttactttcgtatgcccgaccgaactgggtgacgttgctgaccactacgaagaactgcagaaactgggcgtagacgtatacgcagtatctaccgatactcacttcacccacaaagcatggcacagcagctctgaaaccatcgctaaaatcaaatatgcgatgatcggcgacccgactggcgccctgacccgtaacttcgacaacatgcgtgaagatgaaggtctggctgaccgtgcgaccttcgttgttgacccgcagggtatcatccaggcaatcgaagttaccgctgaaggcattggccgtgacgcgtctgacctgctgcgtaaaatcaaagcagcacagtacgtagcttctcacccaggtgaagtttgcccggctaaatggaaagaaggtgaagcaactctggctccgtctctggacctggttggtaaaatctaaatttccttcgtctttcacgccatagcggcgttggcgtcgcccgctcaccccggtcacttacttgtgtaagctcccggggattcacaggctagccgccttgctctgacgcgaaatacttcggaaattcacctaattcttcgggtgctgcggcacccgattttcttccccgcaccatgatgcaagctgcatccaggtagccgcagaggccgcttgcatgatgatgtttaaagcccaggagataaacatgctcgacacaaatatgaaaactcaactcaaggcttaccttgagaaattgaccaagcctgttgagttaattgccacgctggatgacagcgctaaatcggcagaaatcaaggaactgttggctgaaatcgcagaactgtcagacaaagtcacctttaaagaagataacagcttgccggtgcgtaagccgtctttcctgatcaccaacccaggttccaaccaggggccacgttttgcaggctccccgctgggccacgagttcacctcgctggtactggcgttgctgtggaccggtggtcatccgtcgaaagaagcgcagtctctgctggagcagattcgccatattgacggtgattttgaattcgaaacctattactcgctctcttgccacaactgcccggacgtggtgcaggcgctgaacctgatgagcgtactgaacccgcgcatcaagcacactgcaattgacggcggcaccttccagaacgaaatcaccgatcgcaacgtgatgggcgttccggcagtgttcgtaaacgggaaagagtttggtcagggccgcatgacgttgactgaaatcgttgccaaaattgatactggcgcggaaaaacgtgcggcagaagagctgaacaagcgtgatgcttatgacgtattaatcgtcggttccggcccggcgggtgcagcggcagcaatttactccgcacgtaaaggcatccgtaccggtctgatgggcgaacgttttggtggtcagatcctcgataccgttgatatcgaaaactacatttctgtaccgaagactgaagggcagaagctggcaggcgcactgaaagttcacgttgatgaatacgacgttgatgtgatcgacagccagagcgccagcaaactgatcccagcagcagttgaaggtggtctgcatcagattgaaacagcttctggcgcggtactgaaagcacgcagcattatcgtggcgaccggtgcaaaatggcgcaacatgaacgttccgggcgaagatcagtatcgcaccaaaggcgtgacctactgcccgcactgcgacggcccgctgtttaaaggtaaacgcgtagcggttatcggcggcggtaactccggcgtggaagcggcaattgacctggcgggtatcgttgagcacgtaacgctgctggaatttgcgccagaaatgaaagccgaccaggttctgcaggacaaactgcgcagcctgaaaaacgtcgacattattctgaatgcgcaaaccacggaagtgaaaggcgacggcagcaaagtcgttggtctggaatatcgagatcgtgtcagcggcgatattcacaacatcgaactggccggtattttcgtccagattggtctgctgccgaacaccaactggctcgaaggcgcagtcgaacgtaaccgcatgggcgagattatcattgatgcgaaatgcgaaaccaacgtgaaaggcgtgttcgcagcgggtgactgtacgacggttccgtacaagcagatcatcatcgccactggcgaaggtgccaaagcctctctgagtgcttttgactacctgattcgcaccaaaactgcataagaagaagtaagattcacctgcaattgcttagccgccggggtcaaacctggcggcttttttatggcattaaaaagccccgccgggatggctccgggcagggcgggatacttattctggcaattaacgcacaaccagcaccggcagattggcgtggcggatcacgctcgaggcgttagaacctaacagatgggtcgaaatcgatgggttgcgagaaccaataactacaacatcagcccccagttcttctgccaactcattgacttcatcccgcacgctaccaaaacggacatgttgtttaatgcgggaaggatcgatggtgaagtggctgaccatcgtttgcagacgttcttgtgcttcatgttgcagatgctcttcaaaacgacgcacatcagcggcaaaacggtgcaggctcaggctggctgacccgggtagtacgtgaagtagatgaataactccgtcatcctgggcgaggaattcagcgtggcgaacagctttgtcgctcaattccatttcaaatacatcaactggcataatgattgtcttatacataaccctttctccctgttaatcatgaacaaatcattcgccatgattataatatttatccctgatatttgtctggttctttttccttacgaactgtttctgtgatgaatatattctcactgaacaccaggaattctcccaaaacctgtggtaccgcccgttttcccgctgtgatagctacccttaaagactgactcttttttgaactgtctctggaggttgcatgaaagcattgacttatcacggcccacatcacgttcaggtagaaaatgttcccgatccgggcgttgaacaggcagatgatattattctgcgtattacggcaacggcgatctgtggctctgacctccatctttatcgaggcaaaatacctcaggttaaacatggcgatatttttggtcatgaatttatgggggaagtagttgaaaccggaaaggacgtaaaaaatttgcaaaaaggcgaccgagtggtaattccgttcgtcattgcttgtggcgactgttttttctgtcgattgcaacaatatgccgcctgcgaaaataccaatgcgggtaaaggcgctgcgctcaataaaaaacagataccagctccagcggcattgtttggttatagtcacctgtatggcggcgttcctggtgggcaggcggaatatgtccgcgtccctaaagggaatgtggggccgtttaaagtaccgcctttgctttcagatgataaagcgcttttcctttctgatattctgccaacggcatggcaggcagcaaaaaatgcgcagatccaacaaggttcaagcgttgcagtctatggtgctggtcctgtgggattgttgacaatcgcctgtgcacggttgctcggtgcggaacagatttttgttgttgatcatcatccctaccgcttgcatttcgccgccgaccgctacggcgcgatcccgattaattttgatgaagacagcgatccggcacagtcaattattgaacaaacggcaggtcaccggggcgtggatgcagtaatagacgccgtcggttttgaagcgaaaggcagcaccacggaaacggtgctgactaacctgaaactggagggcagcagcggtaaagcgttgcgtcagtgtattgcggcggtcaggcgtggcggcattgttagcgtaccgggcgtctacgctggatttattcacggtttcctgtttggcgacgcctttgataaagggttgtcgtttaaaatgggacagacccacgttcacgcatggctgggagaattattaccgttaattgagaaaggattactgaaaccagaagaaattgttacccactatatgccgtttgaagaggccgcccggggatatgagattttcgaaaaacgtgaagaggagtgccgtaaggtgattctggtacccggtgcacaaagcgcagaggcggcgcagaaggcggtttcaggtctggtgaatgcgatgccggggggaacaatatgatcgtcaggagtggttttcgaggtaaaggacagccatgacgataatcgccgccataatcagaaatcctatcaggatgtaaaatgcttctgccatggttattcccacaaacgaaacggaataattttgcagcaaaagtgaacagtgagaaccaggaaaaattgctgattttgcgtaaagaggatgcgagtgcatcctctgggcaaagcgagttatcgcttgtgcagatgggattaaagcaggtagtcgccagcagcttctggctggtattcgagttccagcacttcaaggtgggttgcaacgccgcccggaagttcccagtgaatggaatcgccaacgcgcagccccagcagtgcggcacctaccggagccataacggaaagctgagtattgctatcggtcatttttgccggatacaccagcgtgcgcacacgcacttcgccatcgctaagattgcggaatttaacccggctgttcattgtcaccacgtcgtgtggcatctcttctggcgaacacatttgggcgcgatccaactctgcgtttaacgcgtcggcgattggcaaaccagcataggcgggttgctccagcagaatatcgatgcgttcggcatccaggtcgttaatgatgatagttggtctggacatttttactccatgtcgtcggtgctgcgagtgtcgcagataaacatacccaaaagaaaaccctcaccgtcaggcggcgagggtttaactcacatgatgatactgactgttgctcactctttgaagtgatttgcgtcacattcagggaattcctcaatgcagcgcattatgtataaatcttaatcgccttggtttatggaagacgaattagcgtgttttgtaaatcagatgattaataacccgctttatcaatcacaaaggttttgccacagttacctgggtgaggttgtggcaagaatgagtttgcagaaagcggagcgttgatggcgtcagctttgatcgagatctgaatttcagtcaaatacgcagggttaccctggcacgttagcttaactgctttcacgttctcttttccccagcttttggcaaaggcggcgtcaaagtcacggcggctcactgttttaccgtaattatccgcaaggaattttccggcttcgctctctttaatttcttgattcaggcgtaccatcgtaccgaagtatgcgtccggatcaaaaccaaagcaggcaccgtgtttggcatattcgtagcgttccaggcaggaacgtccgccagctcctggcatgacttcacttagtttagcggccgtttccagtgataatccggtttccggcgatgaacacattcggctggcgcgcgcttctggtagattcgggattgggcgagtagcgcaaccgaagcgcatccagcggcgttcatcaacaccacgggcagcaaccgatttaggcaatcctggccacagaccatgtacggtcagaaaatcagctttgttggtcgtttcggtttgcaggcgacattcatctcgttcgttacgatttcgatcgtgttgactctggcaaaatccggtttgccaggagagggccaggacatagcgatcaaaatcgccatactgttttgcctgcaacgctaaggcgttggcagaagagaagggaagcagagaaaccgcgagcaacgcggcgttacgccagaatgctttcataatgggtgtggaactcatacatacactgaatactatctattaaatcataaaaaagcccgccaggtgggcttacctggcgggcgtgatgatttattcagcgtttggcgaacgtattagttccacatggcgagaatcggccagccaaccaacagcaacatagagatgtaaatcaccccgaagattgcgccaagacgccagtaatcttttgatttcacatagccacagccgtaaataatcaccccaggaccggttgcatacggcgtcagacagcccatgataccgatagacagcaccagcaggatacacagttgttccattggtacgcccggaatacctttaccgacggccagaataaccggcagcatggttgcggtgtgcgcagacaggctggcaaacaggtagtgtgcaaagtagaacaccagaaccagtacaatcaccgttgcgtttggtgagaatccttccaggtgcgtactcatggtaccggcgaaccagtcaataaaaccagaacgagtcaggccgttagccatcacaaccagagttgccaggttgaccagtgtgttccatgcgctgttatagcgggtaatgtctttccaaggcacaacgtgcagggccagcattagcgaaactgccagcagaccaaccgcagtagcattaatgacttcactgccaaatacccacaaacctaagctgagcaatacaaggccaatcagtgtccactctctgcgtgtcagcgcacccatggttttcagttcatcacccgcccaggttgccacttcttcactgtgtgtgatttccggtttgtacagcacgtaggaaagccacggcgcaatgataagcaagataaccccaaccggcaggaagcagaggaaccactgcaaccagctaatctggataccggcaattttgctgacgaactccagacccagcacgtttggtgccgcaccggtgacaaacatggacgaactcagactggtactaatgaccatcatccacatcaaatagccgccaatacgacgcgcggacggatcgttcgggaatgatttaaacaacggcggcaggtttttaatgaccggaaaaaccgtacccccggtacgcgcggtgttggaaggtgtaaacggtgccagcagaatgtcgataatgacaatcgcataacccaacgtcagcgtgcgtttgcccatgaatttcaccaggaaaagggcaatgcgacgacctaacccggaaacttcataccctaatgcaaaaataaatgcgccaaataccagccataccgtggtgctggaaaaaccagccaggccccatttcagcgcctgtttttgcgcattaaacgctgggtcagctaattctttggcatcaaagagcaggtaattactgccaataacgcaaatagtaaccgcaataaaactgatcgctgttgccggaattggctcgaggatcatgccgacaatcattgccacaaacacagcgaagtaatgccatgcctgcggcggcataccgtcggggacagggataagaaacatgacacccatcaccaccagtggggccaatagtttccatatattatcttttgctaaagacatacgggttctccgaaaattaatatttccaaatttatcaagtgcttaaataattaaatctgtgctaaaaaccaggtaaggatcagtaggtcagcactgccgcctggactgagatttcgttcgatacactccctgtcgaactgccggagataatcgagatcggcgggggttcgaatgccccctttttgcaataatgtttgcgcctcgcgctgtagccagcgcaggcccccctcgccaccgcgcgatgcaacgttggtatcgccgttgatcgccatcagtaggagcaaggtatcgagcaatgccagttcaggatctaacccctgatccagcagagtgaggtaatgcggcaaggcgtgattgatcaccagtggataacccgcttcggcttcaccgcgtgcgccggtaaggccaagctgttggtacaaccgttgacctgccgtcagttgtgaattattggtacgcagttcgcgatcggtcaggccacggcagaaacttgccgccgtagaacaaacggttgttggcgttaccggttggttgagttgaagcaaacggccaattgccgcacatagcagccctaaagaaaaaatgctgcctttatgcgtgtttacgcccgcagtggcgcggaacatatcaccttcgcaagccataccaattgggcgtaatccgtggagtaccgcttctggtgccatttccgcactacaggcaccaaattcaatgaaacggggtagccagccctgaatcgccagcgcgctgcggtggaaatcttccagcgccatatctttgtgcgcaccgcagttaatgcgatccacgaggcctggtttcggtgacagattgacttcagtcagcatggcgcgccagcccagcagggcgtactcatcgattaatgacgtcgcaagctttgtggttttagttgacgttgcaggcatcgacatcgttcagcagtgcctccatgcggttgagtaaatcggtcagttgatgggtttttccacgcgcgcagacggctgcgctttgttcgcacaacaggcagcggcgaggcggcagtgaatagtcgcggcgggagagaatttcgccttcgggcgtcaggacatcgatatcccataaccgcccgagaggatgactatgttcaagctcaatggtggcgagcttgaggtcgcgagccggggcggcaatgctcaacatgccctccggcccgctggcggaaaccagtgcagcctgctcctgaatttgccagccctgttttgcggctaaggcacgcaaggctgtcacgccatgattaaaaattcggcgtgtgacctcgctgtctttaatcggcccaggcgcaaccacggtaaaggagaccagtggaacaggatggcgcttgagccagacgtgttgccgtgcttgcctttcatcccggctgacgagcagctcgggaattgataccgcatggtggctggcgagttcaggaagcaggtgcatggcttattccttcacctgatgcacaacatcgatcaccgagccatcgcggtaacgcacaacggcaacgacgcggtctgtgaattcaatcggctgtggttcaccggtcagcagacgcgcacgttcgcgcagccactcaatggaaaccactttaatgcccgcttcctgcagacgttctgccagttccggacgtgccgggttaactgcgataccgtggtctgtgaccagaatatcgacactggagcctggggtgatgcaggtcagtacgttatccaccagagtcggaatacgaccgcgtaccagcggcgcgacgatgatggaaagcgcagaggcaatcgcggtatcgcagtgaccaccggaagcaccacgcagtacgccgtcagagccggtcagcacgttaacgttgaactgggtgtcaatttccagcgcgctcagtaccaccacgtcgagacgatcaaccgatgcgcctttcgaaccccagttagcgtactggttggcgctgatttcgatgtgattggggttacgggccagcgattgcgcagcatggctgtcaaagctctgcacatccagcagtttgcggatcagacctttttcgtgcaggtcaaccatcgtcgcggtaataccgccaagggcgaagtcggcgcgaatatcgcggctacgcattttgtcttccaggaaacgggttaccgccagcgatgcgccgccggtgccggtttgcatggagaaaccttctttgaagtagccagagttgacaatcacatccgcagcgctacgggcaataagcagttcgcgcgggttagtggtcatacgggtcgcgccagcgccgatttttgcagcatcgccaacgcggtcaactttgacgatcaaatcaacctgatcttgctcaatgcttgccggattatgcggataaggcagcagttcttcggtaagcatcacgacctgttttgcgttgtcggcatcaactattgcatagccgagggagccgcagcaggctttaccggtgtagccgttggcattaccgaattcatcacaggacgggacgccgaggaaagccacgtcgatattcagttcgccgctctgtaccagatgcacacgaccgccgtgagagtggatctgcaccggttctgccagcagaccacgggagatctcttccgccagtggaccacgcaggccggaggtataaatgcgggtaaccacgccctggcgaatgtgttctaccagcggcgcatggcaatcactcagggagctggacgccagggtcaggtttttaaagcccatcttcgcgatgacgtccatcaccatattgacggtcaggtcaccgccacggaaagcgtgatggaaggaaaccgtcatgccgtcctgtaaaccagagcgacgaatcgcttcttccaggttggcgcacagtttgcgatcgcgcgctttttcagcctggtaggtttgctttggcgagttctggaaagcggcaagatcgcattcagcgcgacgattccaggccgctacccgttcttgtcgttgagattgttcaattttctgcgtcattttgattgccttattcttcgcggatgccggaaagttctgcacgggagagcaccagacgggcgcgatcgataaccggaccgtccaccatcttgccgttcagggaaaccacgccgaggccttcgcgagcggcggcttcagcggcttctacgacgcggcgggcgtgatccacttctttctgggtcggtgcgtagaggttgtgcagcagatcaatctgacgcgggttgatcagcgatttgccgtcaaagcccagctgtttgatgtgggcggcttcttgcagaaatccggcttcgttgttagcgtcggaatagacggtatcgaacgcctgaatacccgcagagcgcgcggcctgcaaaatggaacagcgtgcgaacagcagttcagttccttccggggagcgttctgtacgcaggttgcgcacatagtcttctgcaccgagggcgataccgatcaaacgctcggaagcgtgagcgatttccactgcgcgggtaatccccagcggagattcaatcgccgccagcaggccggtgctgccgggttcacgaccacaggctttttcgatacgcaggatctctttttcaatatccagaacatcctgagcggtatcggttttcggcagacgcacaacgtccgcaccaccgcgaacgacggcttccaggtcgttaacaccccattcggaatccagcgcgttgacacgcacaatggtttcaatatcgcgatacagcggatgttgcagcgcgtggtaaaccatgcggcgggcggtgtctttttcacgcaatgctacggagtcttcgaggtcaaacatcagggcatcagccgggtagatgaaggagttgctgaccatcgcggcattggcaccaggcacaaacaacatgctgcggcgggtgcgagttttacgttgttgcagcgaagcggaaatcattggcaatcctcccatggcagagccgggataccgctggcgcgtgccagcagggcttccagtcgtgcacgtaaaatgcagtccagtgcgcctttgtcatcgacattcagctgtacgccgcgcacgttgtagcgggcgagaacgtccagaatggtggtgcgaattgcatcgccaaactgtttctcaacgctgctattgatttgcaggtcgatatcctgcgtatcgagtggggcgatgcgtatcatcacatccccagactcaagggtgcctgcaacggcgggctggtttattttcatttttcacctgtttctcatgcgggggtcttttgacgagctgccgcgtcctggcgggagtgctcaagcaggttctgcaaataatgcagcgtgactgcagggaccagcggcgcgatagccgtgagatcgtttttcgccagcagttgacgtacccgggaagcggatatcggcatctcctggtaacgcagccgctcaatttcaaccagttcgatgggcggtgcggagatagtcggcgtttccagccagtagcgcatatcctggttgtactgggcggtaacgcgacaaaagggttcagtaccgacaaagcggtgagttacacccagcgcgggagcgaggtactgacggaaaatcttcagatcaatttcggtgtaacaatggttaatgacgctctgttctttaatgaagtagcaagggaacgtagcgcgggagatgatgtattcggagccacgatgcacagtcaggcgtggaatatcggcggtgccttttaacaccaaatccagccggtcttcataggggaagcgtgaagaatcttctttgactaaaaacagatgcaaccagtcgcactgtgccgcagcctgttgaatcagataacggtgaccattcgtaaagggattggcgttcatcacaatgcagccaatcttgttccctggatgacgaaattttttcagcgattcggcatagcgtttcagtcgcgtggcgctgttttccatcagcaccatcacgccgggtacgctggtcagcgtggaaaaaccgcactggcggaacagcgcctcgtattcggttttggtataaataaacagatgcgtgctgtgccgctcataggcgaggtttatcaattcagtggctaatgtcagcgccagtccttcaccgcggacggattcactgatagcaacgcatttaataatatttccggcaattccaccgcacgcgataagcttttcatcgcgggttacggtaataaatacttcgactgtggtgtcaacgctcaaatcattttcatgcaggaattgggcgatttccgccatttttttattttctgaacgttttacgcgggtgaaaatatcattgccgaacataataaatagtatcctgaaggtgcatgttgttatcgatttgcaacgaatgttgttcaatgttgcaaactgataaccttttattttcacttgggagaaagggggtgatcgaggtatatctttttctcctttcgctatacatcctaaggagtatttcggcgtgaaattttgatttatttcacatagagttagtggttttttatttatttaatgattttaagttttttaattaatgtaattacgaaatgactcgcaggtttaagtgatttaattgatttaatgaataaaatttgccacgatcataattaatatctatgtattttgattcaacattttaattacatccgtcaaagaggctcgggacaacccgcaaggaaaacaatgttgcagcttaacgagaataaacagtttgcatttttccaaagactggcatttccgctgcgtatctttttgctgattctggtgttctcaatatttgtcattgcagccctggcgcaatattttacggccagttttgaggactatttaacgcttcatgtacgcgacatggcaatgaatcaggcgaaaattattgcctccaatgacagtgtcatctctgcggtgaaaacgcgtgactacaaacggctggcgaccatcgctaacaaattacaaagagataccgattttgattatgtggtgattggggaccggcactcgatccgcctttaccatcctaatccggagaaaattggttatcctatgcagttcaccaaacagggcgcgctggagaaaggggagagctacttcattaccgggaaagggtcaatggggatggcgatgcgcgccaaaacgccaatctttgatgacgatggaaaagtcatcggcgtggtgtcgattggctacctggtgagtaaaatcgatagctggcgggctgagtttttattaccgatggcaggtgtgtttgtcgtgctgttagggattctgatgttgctgtcgtggttcctggccgcgcatatccgtcggcagatgatgggcatggagccaaagcaaatcgcacgcgtggtccgtcagcaagaggcgctgtttagttcggtttatgaagggctgattgcggtggatccgcatggttacattaccgccatcaatcgtaacgcaagaaagatgctggggctgagttcccccggacggcaatggttgggtaaacccattgttgaagtggtcaggcccgccgatttctttaccgaacagattgatgaaaaacgtcaggatgtggtggcgaactttaacggtctgagcgttattgccaaccgggaagctattcgttcaggtgatgatttgctgggggccattatcagctttcgtagtaaagacgaaatttccaccctcaatgcgcaactgacgcaaataaaacaatacgttgagagccttcgtacattgcgacacgagcatctcaattggatgtcgacgctcaatggtctgttgcagatgaaagagtatgatcgcgtgctggcgatggtgcagggggagtctcaggcccagcaacagcttattgacagcctgcgcgaggcgtttgccgatcgccaggtggcggggctgctttttggtaaagtgcagcgcgcccgggaactggggctaaaaatgatcattgtccccggtagccagctttcgcaactgccgccaggactggatagcaccgagtttgcagccattgtgggcaatttacttgataacgccttcgaagccagcctgcgtagcgatgaaggaaacaagatcgttgaattattcctcagcgatgaaggcgatgatgtggtgattgaagtcgccgatcagggctgcggcgttccagagtctctacgagacaaaatatttgagcagggggtcagtacgcgtgctgacgagcccggtgaacatggcattgggttgtacttgattgccagctacgtaacgcgctgcggtggtgttatcactctcgaagataatgatccctgcggtaccttattttcaatctatattccgaaagtgaaacctaatgacagctccattaaccctattgatcgttgaggacgaaacgccgctggcagagatgcatgcggaatatattcgtcacattcccggattcagtcagatattactggcgggaaatctggcgcaggcccgaatgatgatcgagcgttttaagccggggctaatcttgctcgataactatcttcctgacggtagagggattaatttactgcatgaactggtgcaggcgcattatcccggcgacgtggtgtttaccactgcagccagcgatatggaaacggtgtctgaagccgtacgttgtggtgtatttgattatctcattaagcccattgcctatgaacggctggggcaaacgctaacccgtttccgccagcgtaaacatatgctggaaagtattgatagcgccagccagaagcaaattgatgagatgtttaatgcttatgctcgcggtgaacctaaggacgagctaccgaccggcattgaccccttgacgctaaacgcggtgcgaaaactgtttaaagagcctggtgtgcaacatacggcagaaacggtggcgcaggcactgaccatcagccgcaccactgccaggcgttatcttgaatattgcgccagccgccatctgattattgctgaaattgttcacggcaaagttggcagaccacaacgcatataccacagtgggtgacatgataaagccggaggaaacttgcctccggcattactatttacttgcctgtgaccgctgctgccgttcctggcaccatcagctctgtagcaacgataacaatcaccaaaccaacaagcaccggtaccgaggtgcgttttacgacttcaaacggcgagatcttcgccatcccggcaaccgcaacgactacgccagaaacgggcgaaagggtacggccaaggtttgacgcctgcagcatcgggatagtcaaatacgccgggttaatgccggaagagtgcgccagtttcgggatcatctcaacaaacgcataaaacggcgcattgcctgaaccggtcgtgactgccgccagcattgtcagaatcaccaataccagcatcaggatgatactcgccgaaccaaacgaggtagcgatagaaatcagactttgaataaagccgatggtgctaagcccctgagcgaataccccagcggcaaccagcagcatcaccacgttagcaaacgcatctgccatcccgcgataagccacttccagaccagagaaaactttctgggtattaaagctgcggaggaactccagaatggaggcaatcagcatacaaatcaccagaatagtgatgatgtgtaattgcggaccccatttaccgtcaaaaatcagtacaccgatgatcggcgtgaacggcaaaatggcataaaacgcaggagcagtggtggtgatttcactgacatctaacatttcatgagagatgtgctcttttttatccagataacgttgccagaagaagtgggcgatcgccatgccgataattgcagcaattgagataggcagcgtcgttttgaaggcgaagtcaatcagcgacatttcggaagcttgcgccgccagcaccacatcccctgaagtcggtgcgagaataatcgccgccggggaggcacaaatggcagcagctgcgccacgactgataccaacgtttaccatcaccggaaatagggttgccatcagcaaaacacccagaccggttgcggaagagacggccagagacatcagacaggcgacaaaataggcggcaatcatcagcaggtaaggggagttaatatactgcaatggttttgacgccagcttgaccaccatatcattcgcgccgatatgggtcatgtaagcggcaaatccacacagcatcataatcatcatgccgaggtcgccgccgcggctcattagtaatattttaacgtattcaacgatatccgtggcgctgtagcctgttgaagcctggctggacggtaacactttgtgccccataatggcactgataatcagcaataacaggccaccgacaaataacacaccagtggcggaataccctttaatgatgtagcgagctacacccacaataaccacaaccccaataaggagctcaatgaatgtcagcataatttttcctgtctccaggccccaaagtaaataataaaaaattcctaaagcttaaggaaaaaatatgcccaataaattggcgatgaatgctgattaaaatcaagaaaaactgccattaagacattgaagttgctgtttttatacatagataacaaaacgcatatttagcggttggcaattatcacataataatgtgtgcaaattgatggtggattgatgcaaatttgttaattgcaatggtgttagctgcggctgtgcgctcaaaaaataatctaatatgagcataggttgacgatatatattatatacttcgttaagatgattgttgtatctcgttaaaaaataaaataatttttccttgattgcattttgtcatcaaaaaagacttggtttttcttttttgactattcccatcgcagaaaacgacgcatcatctttaatcgatgcgcggaaatatttaacttgaacaagcggaaataaatagagcagctattcagattattctttatgttgggtctattaaggttatgttaattgtagctttgctatgctagtagtagatttttgataaatgttttatggtcacaaatgaacgtgagtaaatatgtcgctatcttttcctttgtttttattcagttaatcagcgttggtaaagtttttgctaacgcagatgagtggatgacaacgtttagagaaaatattgcacaaacctggcaacagcctgaacattatgatttatatattcctgccatcacctggcatgcacgtttcgcttacgacaaagaaaaaaccgatcgctataacgagcgaccgtggggtggcggttttggcctgtcgcgttgggatgaaaaaggaaactggcatggcctgtatgccatggcatttaaggactcgtggaacaaatgggaaccgattgccggatacggatgggaaagtacctggcgaccgctggcggatgaaaattttcatttaggtctgggattcaccgctggcgtaacggcacgcgataactggaattacatccctctcccggttctactgccattggcctccgtgggttatggcccagtgacttttcagatgacctacattccgggtacctacaacaatggcaatgtgtactttgcctggatgcgctttcagttttgagacaaatgaagttttagtaacttctttaaaatcaatagctaaaataagtaacatcaaaaataacgcgacttttatcactttttagtaaagttacactggacaaagcgtaccacaattggtgtactggtaaccgacacagcatttgtgtctatttttcatgtaaaggtaattttgatgtctaagattaaaggtaacgttaagtggtttaatgagtccaaaggattcggtttcattactccggaagacggcagcaaagacgtgttcgtacacttctctgcaatccagactaatggttttaaaactcttgctgaaggtcagcgcgtagagttcgaaatcactaacggtgccaaaggcccttctgctgcaaacgtaatcgctctgtaagatacgtcagcaagaattcaaaacccgcttaatcagcgggttttttttggtctttagtgtgcggttgaggccgaaaacagccagaatgccagtgcggtcatggcaaaagaccccagaaggttgacgaaaacgttcagtaatgcccagccaaagcggccctcttgtaacaaaaacaccacttctgccgaaaatgttgagaaggttgttagaccgccacaaaatccggtggtgattaatactttccacactggatcaatgttcgtcatcctgctgaaccatgcgaatcctattcctatgatgaatgccccaatcaggtttgctgtcagcgtccccaacggaatcgcctgatgcagtgggttaaatcgcatacttaacagccatctcgccacgcttcccgtaccaccgccaataaaaactgctaaaagaagttgtaacactgcaaaatcctgctatttgatttgtatgagtgataagtgtaacgccgaataatcgtcgttggcgaattttacgactctgacaggaggtggcaatgctggttgccgcaggacagtttgctgttacatctgtgtgggaaaagaacgctgagatttgtgcctcgttgatggcgcaggcggcggaaaacgacgcatcgctgtttgccctgccggaagcattgctggcgcgcgatgatcatgatgcagatctatcggttaaatcagcacagctgctggaaggcgaattcctcggactttacggcgagaaagtaaacgtaacatgatgacgacaattctgacgattcatgttccttcaacgccggggcgcgcatggaatatgctggtggcacttcaggcaggaaacatcgtcgcccgttatgccaaactgcatctctatgatgcatttgccattcaggaatcacgccgtgttgatgctggtaatgaaatcgctccgttactggaggtggaagggatgaaggtcggtctgatgacctgttatgacttacgctttccagagctggcgctggcacaggcattacagggagctgaaatcctggtacttcctgccgcctgggttcgcgggccgctcaaagagcatcactggtcaacgttgcttgccgctcgtgcgctggataccacctgttatatggtggcggcgggggagtgcgggaacaaaaatatcggtcaaagccggattatagatccctttggcgtcaccattgcggcagcgtcagaaatgcctgcactcattatggcggaagtgacgcccgaacgtgtgcgtcaggtgcgcgcgcaactgcccgtcttaaacaaccgtcgctttgcgccgccgcaattattatgatgtttttttactcggcgcttgattcaccttgttacagattgctattgtgtgcgcgcgtcgaatgaccgttaatattctctggtttttaaggcgcgttctgttgccggttatatgtcaagaaggtatctatgggtgagattagtattaccaaactgctggtagttgcggcgctggtcgttctgctgtttgggactaagaagttacgtacgctgggcggagaccttggagcggccattaaagggttcaagaaggcgatgaatgatgacgatgctgcggcgaaaaaaggcgcagacgttgatcttcaggctgaaaagctctctcataaagagtgacgtggcgagcaggacgctccctcaatatcttgttcgatacaaaaaacccgcttcaaaaagcgggttttttatcagacagatgtaagtaattattacaggattacttaacttccatccctttcgcctgcaaatcggcgtggtaagaagagcggacaaacggaccgcatgcagcatgggtaaagcccatcgccagcgcttcggctttcatttcgtcgaactcatccgggctaacgtaacgttgaaccggcaggtgatggcggcttggctgcaaatattgccccagcgttaacatcgtcacaccatgacggcgcaggtcgcgcattacctcaataatttcttcattggtttcacccagtcccaccatcagaccagacttggtcgggatttccggatgcgcttctttaaagcgttccagcagcttcagcgaccagttgtaatctgcaccaggccgtacctgacggtaaatacgcggtacgttttccaggttatggttgaacacatctggtggcgttgcagtcagaatatccagagcacgatccatacgaccgcggaaatccggcaccagagtttcaattttgatttgcgggcttttttcccgaatggcagtaatgcaatccgcaaagtgctgggcaccgccatcgcgcaggtcatcacggtcaacggaggtgataaccacataacgcagcgccatatcggcaatggtctgcgccagtttcactggttcattggcatcaggagctaccgggcgaccgtgggcaacatcacagaacggacaacggcgggtacaaatagcgccgaggatcataaacgttgctgtgccgtggttgaagcattccgccaggttagggcaggaggcttcctcgcagacagaatgcaggccatttttgcgcattgcggctttgatgccctggatacgtgtagagtccgctggaagcttgattttcatccattccggcttgcgcagcagggcttcgcgctctgttgccacgtttttaaccgggataagggccatcttatcggcatcgcggtatttaacaccgcgttccatcacaatgggtttactcatagcgtgcgtgttccagttgcgaattacgaaggaaagcgtttcaattcaatagattgttgtaattatcaactatttttgaattaacgactggcagtatatcattgaaacggacctgaaagcagccaaagcggtcgcgaaaatgtaaaattgttgttggattgtgccattttatcgttctgcgctgtgatctggctgtaacaatactttttcaaaatgcattacggataacatctattactccgtgcaggatgggatcacgcaggctgaatttgttgtagtggatagagaaatctatttgctcctcatttaaggacggaaaaggcagtttttccagcggccagcagcggctaaacaggttataaaaacggctgggaataatcgctaacatgtcactgttggcaaccagtgcagcgattgtcaaaatgttgtagctggtgaaattgatttgccggtccggaaacatttcttgaactctctgccgcagaccgctgaaattttgctcttccggtaacagaagtacatgcgcagcgttgtcgatagtctctctgtcatcttctaaagagagtagtggatttccctcgcggcaaattaacaccatattgtcggtgaacagaacatgatgttgcaccgtacgattggtgcaaaacatgttatcgatgatgagatcggtttgaaactgactgagttggttttccgcgtcgctgatgggcgggttgcgcagtaaaagctgcggatagtgagttttaatcgcccgatagatgacaggaaggaccagtgctccgaccgagggagtggtcgcaatagttatcgttcgttgcttatcatagcttccttcgatatccagcgcgccaagaatggactcaaggccctgactgatatactcatgtagatgcatcgcaaatgcggtaggagtgacaccctggcctttgcgaataaacaatgggtcagggaatataacgcgcagtttctgaatagactgactgattgccgagggggtcagattaagcactttcgctgcattaacgatccctttatgtacatatacagcttcaaaaatagtcagaaggttaagatcaatatttcgtaaggttgtaaatatttgtggtttaccttctgacgactttctgcttaaacagggttcaatttgattattactatccacgcacttactccaattttattcatggaaaaataatatttaaaaaattacaataatcttatgtctaattggaacggaacgcttttgctcaccataatcaactatttcaataggttaatcaatggggtgagttacggagcaaggcgtggcaccgcatttctgcaagtgataaagaaaatatacaaacgcgaaggagatgtaaagcattagcagatattatgagtaatgacccagtgtaaattgggccattgatgtatggaattaagcggtaatatattcgaagtccggattgtttagtagcgctaaaatattttccagtaaacgtggagcaatattattagtcgtcgcttcgggtttccattgtgatattttagccatttccattccggcatacccacaaggattaatacgtaaaaatggtgaaagatccatattgacgtttaatgccagaccgtggaatgaacaaccgcgtcgaatacgtaaacccagtgagcaaattttcttttccccaacatagacacctggcgcgtcagcccgaggatgcgcttctatacccagttcagccagggtattcaccactgtttgctcaagcaaggtcaccagttcacgcacaccgagtttacggcgtttcaggttaagcaacacatacatcacctgttgccccggcccgtgataagtcacctgcccaccgcgatcgctctggatcaccggaatatcacccggcattaaaatgtgctccgcttttcctgcctgaccttgggtgaataccggatagtgctcgaccagccagatttcatcaagggtactatcatcgcgggtatcggtgaattcatgcatagcctgggagattggctcgtaaggctgaagaccgagctggcggacaagaattttatcctgatacaaaacggcatctccgtggagaatgagtaaaagtgggggaaaagtatatcacagcgaggagaggggagttacccgaccaggagccgggtaacggagaagcgagttacagaaccatgcggacaatatcgattttgcccagttcttcatacagtgtttcaacctgctcgatatgagtggcgttgatagtgatagataccgagtggtagttgcctttgctgcttggttttaccgttggggtgtagtcacctggcgcatggcgctgtaccacttcaaccacctgatcaaccagctcaggtaacgcctgccccataactttgtaagtaaaaggagtagggaattcaagcagttcgttaagtttggttttcatgtcagctccggcgtaacgtaattaaatagcaactcccgccagaaggcgggagttttttactgatgcttagtatatggggacggaaattacactttcaagtgtttaatttttaaccaaaccagtgatggaacattaatttaatgtaatcaatgattttgccgaagaagttaccttccgggatttcttgcaacacaaccagcgggcgttgctcgatcgttttgccatcaagctggaagttgatagttccgacgacctgattcttttgcagcggcgcatgcaattcactgctgttcagcacatagctggctttcagatctttcatgcgaccacgcggaatggtcaggtacacgtctttatcaacccctaacgaagcgcgatcagaatcaccaaaccaaaccggttcagaggcgaactctttacctactttcagtgggttaacggtttcaaagaaacggaagccccaggttagcagttttttactttcggcttcacggcctttaaaagtacgtccgcccattaccgcagaaatcaagcgcatctggccttcagtcgcagaagcaacaaggttgtaacctgctttgtcagtgtgtccggttttgatgccgtcgacattcaggctgttatcccataacaggccgttacggttcagctggcgaataccgttaaacgtaaattctttttctttatagatcgagtattcattcggtacgtcacggatcaatgcctggccgatcagcgccatatctcgcgcggagctgtactgaccatcagcatccagaccatgtaccgtctggaagtgggtatttttcaggcccagtgcgttaacgtagctgttcatcaagccaacaaaagcgtcctggctaccagcggcaaaatcggccatggcgacacaagcatcgttacccgattgcaggttaataccgcggatcagctgagaaaccggaacctgcatgcccggtttgaggaacatcagcgaagaacctttaaacaccgggttaccggtggcccatgcgtcgttgccgatagtgactaaatcagtttctttaaatttaccggctttcattgcctggccgataacgtaactggtcatcattttggtcaggctggcaggatcgcggcggacatctgcgttctgttcggcgagcactttgccggagttatagtcaatcaggatgtaggactccgcatcgatctgcggtacacccgggatcatagttttgatattcaggtcatcggcatgtgcagcagagataaaggctgtgcaaagagccgtggtgagcgccaggcgcttcatgatacgagcggaaaaaatggtattcatggtctgaactacgacatccgtgatggaattaaaaaagtgccctactatagcaaatgcactaccggcaggcatctgactttccgcgtgactttgttaacgtcatttacagaaattgacacatcagatgcctgctttacgctactgcgcggtagtaataaatgactgtaattgggcttcggtttgcaaacgttgctgcaaggtactggcttcggctttgctggcgaatgggccaagctggatccgccagaccgcgccattttgagttacgcgaccggggacgccgaacttctgtcccagttgctgttggtactgttgcgcacgagcctgatcgcttacggccccgacttgcaccataaagttgccgctggcgctttgcgagacggcttgcggtgtcaccattgcaggcgaggttgcaggcgttgtcgacggagctgtaacaacgggctgtggcgcaggcgtcggttcgctgccttccagtacaccaggcgctaaggtcgttggtgcgccgaggaaaccgctactggttaccggcgcgccggtcggatcttcgctttttagcgtcgaattactgaccggaagaatgtcaccctgcgggccagacactgaacttgttcccgcgccaccgcttaaatcgggaggtgcaggcagggcgtaagtctgtttggcgactgtggtacaagccataccaggaccagaaagcgaaccatcctgggcaacaataatcggatcgatacgaactttggtgttgtttgacgtgttaagacggtcagctgccgcgcgagaaagtgaaataacgcggtcgttgccgtaagggccgcgatcattaatgcgcaccacgatcattcgcccgttagccaggttagtgattctggcgtagctggggatcggaagcgttggatgggctgccgtcagctgtgtcggatcgaatgcttcgccagaggccgtcaggttactgccgggttcggcatcatagattgccgccagtcccgcctggctaaatcgagacggatcctgcacgattttgtagcttttaccgtcgcgctggtaatcctgatttgccgtcgcgttcagtggttcgaaacgcgggtccgccccgctaatttcaactatagggccgttacataccgcaggctgcggtacacttaccgtctgttgctgaccatcatcgcttgtacatgccgcgagcattcctgccgcgatgcagatcccgagccactgcttacgcattgcgcacctcttacacgcttttcgacaacattttcctgtgggtgtggattgacattacaatcccgaacccagccatcagcacaattagcgccgatcctccataactgaccagtgggagcggaacccctacaaccggcagaataccgcttaccataccaatatttacgaagacataaacgaataatatcagcattaagccgccagccatgacgcgaccaaaggtggtttgcgctctggcggctatccacagcccgcgcatgatcagcagaatgtagagagcgagcagaatcagaatgcccactaatcccagctcttccgccagtaccgcgaagataaagtcagtatggcgttcggggagaaattcaagctgtgactgagtgccgtgcagccagcctttgccgcgtaatccgccggagccaatagcaattttagactgaataatgtgatagcccgcgccgagtgggtctgattccgggtccaggagcatcattacgcgctggcgctggtaatcatgcatcaggaagaaccacagaatcggaatgaacgccgctaccagcactactgcgacgccaatcagacgccagctaaggccagagaggaacagtacaaacagaccggaaagcgcaacgaggattgatgttcccaggtcaggctgtgcagccaccagcagcgtgggcataaatatcagcaccagcgcgatgccagtgttcttcaacgatggcgggcaaacgtcgcggttgataaagcgcgcaaccatcagtggtacggctattttggcaatttccgacggctgaaaacgaacaataccgaggtccagccagcgttgagcacctttagagatggcaccgaaagcatctaccgccaccagcaaaataatacagatgatatagagatagggggcccagccttcataaacgcgtggaggaatttgcgccatcaccaccatgatgaccagacccatcgcgatttggccgattttacgctccatcatgccaatatcctgaccgctggcgctccagataaccagggcgctgtaaaccagcaatgccagtaagatcagcagcattgtgggatcgagatggactttatcccagaatgtttttttattcggattatccgtcatgattaatggtcctccgctgcggcaaccgctggattttccgcaggcagatcggtgttgttatcacccagcataatgtggtcgaggatctggcgcatcagtgtaccaaccgccggacccgcaccaccgttctccagaatcatggcgacagccacttgcggattgttgtatggcgcaaaggcggtcatcagtttgtggtcacgtaaacgctcggcaattttgtgcgcattataggtttcgttcgctttcagaccgaagacctgagcggtaccggatttcgccgcaattttgtacggtgcgctagcaaagtatttatgcgccgtaccgttagggcggttagcaacaccgtacataccgtctttcgccagctcccagtaaccggaatgaatatcgccgacgggcggttcatgcggctgtacccatggcacctgtttgccgtcttcggcggtgctcatcagcaaatgaggaaccttcacgataccgtcattaatcaggatcatcagtgccttactcatctggattggggtcgctgtccagtaaccctgaccgataccaaccggaatggtgtcaccctgataccacggttttttaaagcgtttctgtttccattcgcgggtaggcatgttgccggaacgttcttccgccaggtcgataccggtgtaatgaccataaccgaatttacccatccattcggagaggcgatcgatccccatatcgtaggccacctgatagaagaaggtatccgcagattcttccagcgatcttgtgacattcagacgcccgtggccccattttttccagtcacgataacgtttttccgaacctggcagttgccaccagcctgggtcaaacagcgtcgtattgcgcgtgatcaccccggcgctcaatgccgaaaccgccacatagggtttaactgtagacgcgggaggataaaccccctgtgtggcgcggttcaccagcggtgtattcggatcgttcaacaaggcggaataatctttgctggagataccgtcaacaaacaagtttgggtcataactaggcgtggaaaccagcgccagcaccccacctgtacgcggatcggtgactaccacagctgcgcggctacccgccagcagcgtttcaatatattgctggagtttgagatccagcgtcaggtaaatatcgtgtccggcttgcggtggtacttcttttaactggcgaataacacgcccacggttgttaacttcaacctcttcataaccggtctgaccgtgcagcacatcttcatagtaacgctcaatgcccagcttaccgatatcatgcgttgccgcatagttggccagtttgccgtcattattcaggcgttcgacgtctttatcgttgattttcgacacatagccgatgacgtgggtcaacgccgaaccgtaaggatagtaacgacgtttatagcctttaacttcgacacccggaaaacggtactgattgacggcaaagcgagctacttgtacttcggtcaggttagttttcaccggaatagaggtgaaacggtgtgaacgtgcgcgctcttttcggaatgcagcaatatcgtcatcggtcagatctaccacgctgcgcaaagcgtccagcgtttgctgcacgttatcgactttctccggcatcatttctatctggtagatagtgcggttgagggccagagggataccgttacgatcgtagataatgccgcggctgggcgcgataggcaccagcttaatgcggttttcattagagcgggtctggtagtcggtaaagcgaacaatttgcagattatacaggttggcgataagcacgccggtcagcagcaaaatccccaaaaaggcgaccagcgcccggcgcacaaacagcgcggactctgccgtatagtcgcgaaaagagttctgtagtttcatccgctgcgttttctactcaaagctcccttatcactcacggtgataaggatggttggtggtgatgctccacgcccggtacagactctctgcgaccagcacgcgaaccagcggatgggggagggtaagcgccgacagcgaccagctctgctcagccgccgctttacaggcaggcgacaacccttcaggcccgccaatcagtagactgacgtcgcgaccatccagcttccagcgttccagctcagcggctaactgcggcgtatcccagggcttgcctggaatatcgagggtgacaatgcggtttttgcctgcggccgccaacatctgctcaccctctttgtcgagtatgcgcttgatgtccgcattcttgccgcgttttccggccggaatttcaatcagctcgaagggcatatctttcggaaaacgacgcaggtactcggtaaaaccggtttgtacccagtccggcattttcgttcccacggcgacaagttgcagcttcacgcattaactccagagtttttccagttcatacaggcgacggctctcttcctgcatgacatggacaatcacatcgcccaaatccacgacaatccagtcggcgctgttttcaccttctacgccgagcggtaacaggcccgctgcgcgagactcctgcacaacgtggtcagcaatggacataacatgacggctggacgtacccgtacagatgatcatgcagtcggtgatgctggatttgccctgaacgtctaaggcgatgatgtcctgacctttgaggtcatcaattttgtcgataacaaaatcctggagtgctttaccctgcaagttttccccctgggtgaatcaaatagataaaaatggtctgtcagtatacctgaaccagaggcgatttcgggacaattgtcgccgaatcggctttcgaaagtgggctatcatcccaccccgcgccgcagattgcatcgccatttttgtaaaacaatttctacaaagtcgtgtctggcggaaaaagtctggctgcggagaatatcagcctgcccgggtctgtcaatggtcgttgcggcttacccgtaaaaaaacagaaaagtcatgcattctcgaccccgatggcacggctattgaggacgcgtagcgtcgcgaatttttggttgatatcaatggcgctccaacacccctggtcaacgcgaaaatgccacatagcttcggcaggcatgccaattaaacgggcgattaacagactcagtacaccctgatggctgacgactaaaatattctgatagtgctgaaattcactaagccttgcgataaagcgttccacacgttgcgaaaatgcctgaaatccttcaccgttcgtggggattgcatgctgccagtcattgcaccacgcgctatagttttcggcatcttcttgcatgaggtcgcgatgatgtcgcatctcccagtcgccaaaaaacatttcgttgagttcaggtatgatttgcacggggagctggcggtcactgagaaccagtcgcgcggtatgctgtgcccgttccagttcactgcataaaaccagatcaaaggaaacaccatgtagcagcgtatgcagattttgcgcttgctcaataccgcgcgcggtcaggggggtgggcgcatgaccgctgtaaagaccatcgatattcgcttgcgtttcaccatgacgaattaaccacagtcgcatcatgccctccgtaacgacaggtatcagcgatacaagccttgttggttaatgtaagtcagtaccggttccggcaataaatcctcacatgattcaccgttttgcaaacgttcgcggatgatggtcgccgagatgttaaaccacggcgtttcagccagataaattttaccggcaggctgaaggtgaagatcttccgggttatgtgtcaaatgatcttccagccattgctggtattgcggttgcgccatttcaagtgggtaacctggacgccgacagacgatcaaatgtgcattgtcgagtatcgtttcgtattcgtaccaggtcggaaaggtcagcagtgaatcctgaccaataataaacgccagcggcacgtccggtccttgttcctgccgccactctttcagtgtttgcgcagtgtaagagggggcattgcgctttagctcgcgttcatcaagagtaaataatggcttgtcggcaatcgccagttcaagcatgtgtttacgctgcacgctgttcgcttccggctggggacgatgcggaggaacattattagggatgattgtgacccgcgtcagaccaatcaaattcgccagcgtttccacgggttttagatgaccatagtgcaccggatcaaaggtgccgccaaacagagcctgtaaagatttcatatcaaccgtcgataaatacgtccgccaggggtttatggcacaacagaagagataacccttccagctctgcccacactgactgaccgtaatcttgtttgagggtgagttccgttcgtgtcaggagttgcacggcctgacgtaactgcgtctgacttaagcgatttaacgcctcgcccatcatgccccggcggttctgccatacccgatgcttatcaaacaacgcacgcagtggcgtatgggcagactggcgtttcaggttaaccagtaacaacagttcacgttgtaatgtgcgcaacaaaataaccggttcgctgccttccagacgcagttgctgaagaatatgcaatgcgcgcttactttttcccatcaacaaagcatcaacccaatgaaaaggggtgaaatgcgcggcatcattcaccgcctgttcaacgcgcggtaatgtcaatttgccgtctggccagagcagcgataaacgctccagtgcctgagccagcgccagcaggttaccttcataacagtagcagagcacctgatttgccgcgtcatccagttctaagttgagctgttttgcgcgcgcagcaacccagcggggaagctgagcctgctccggtgtctgacaggtcacctgcacgctgcgattcgcaagcgcagtaaaccaggcggcattttcttgcgctttgcttaatttattaccgcggacgatcaacagcaggtcgtcatgcagaagtccggtgagtgtgagaagttgctcattgatcgccgcattcggtccgttttctggtaacaacagcaatagcgtttgtcgactggcaaacagactcatagcctggcataacgaaaagatcgcattccagtcagtgttgggatcaatggaaaaagtgtggtgttcttcgaatccttgtgccgcagctacctgacgaacagcgtcctggctttcctgcaataacagaggatcgttaccaagtaaaagatacgccgcgcgcagcccttcattgagctgcgcgcggagttgttccgggtacaaccgaatcatcagttacccagcgtggtggagacgcgtgcaggcgttgccggagtatccgttgtggtcgacgtctgttcttcgtcggaacgaatatccgcagcacggatgcttggcagcttacgaatcagctgttcggcagcacggtcgtacatctcttttacgatcatgtcttgttcgttatctttcgctaacgccatttgcgggttatcgaagaacgaacggaagactttggcgctaatcgggtagatatcacggccggggatcaacacggtcgcattaaccgtcatgatcatctgatactctgctgtttgaccgttacggaataccgatgcggtatctttcgcgatgctcactttacccaaacgcaaggatggaacgtccttacgcgtggtttctttatcaagcaactcgacaccattcagacgtaactggttacgcaccgcacggcttaatggcccgttcggatcgcctgagtccaggatcatgaccttcatagtggaaggaacctgcgtggtatcacgcagatgccagccacacccggcggtgattaacaccgccagagataacaacaatgttgccagatatcgcacgcttcctcccgcgcttagccaacgaccagattgaggagtttacctggtacgtaaatcactttacgtacagtaacgccatcaagatattttgctaccagatgttcctggccagcacgttcgcgaacctgttcttccgttgcgtccaccggaacggtgattttggcacggactttaccgttaacctgcaccacgaccagcgtggagtcttccaccatcgctttttcgtcagcaaccggccacggcgcgttgtcgatatcgccttcgcctttcagttcctgccacagcgtgaagcagatgtgcggggtgaacgggttaagcatacggacaacggccagcagtgcttcctgcatcagagcgcgatcctgctcgccatcggttggtgctttcgccagtttgttcatcagctccataatcgccgcaattgcggtgttgaaggtctgacgacggccgatatcatcggtcactttagcgatcgttttatgcacatcgcgacgcagcgctttctgattttcagtcagcgcatcaacgttcagtgccgcaacatcaccttttgctgtgtgctcgtaaaccagtttccagacacgtttcaggaagcggttagccccttccacaccggattcctgccattcgagagtcatatcagccggagaagcaaacatcataaacagacgaacggtgtccgcgccgtaacgttcaaccatcacctgcgggtcgataccgttgttcttcgacttggacattttgctcatgccggtataaaccagttcatggcctgccgcatctttcgctttcacgatacggcctttctcgtcacgttcaacgatagcatcaaccggggaaacccagttacgttcgccgttttcgccaacatagtagaaggcatctgccagcaccataccctgacacagcaactgtttcgctggttcgtcagagttcaccatgcctgcatcacgcatcagtttgtggaagaagcggaagtagagcaggtgcataatggcgtgttcaataccaccaatgtagatatccaccggcagccagtagttagccgcttcggaatccagcataccttctttgtactgcgggcaagtgtagcgcgcatagtaccaggaggactccataaaggtgtcgaaagtgtcggtttcacgcagtgctggcataccgttaacggtagttttcgcccactccggatctgctttaatcgggctggtaatgccgtccattaccacatcttccggcaggatcaccggcagctggtcgtccggggtcggcattacggtaccgtcttccagcgtcaccatcggaatcggcgcgccccagtaacgctgacgggaaacaccccagtcgcgcaggcggtagttcactttacgctcgccaacgcccatcgcagtcagtttatcggcgatggcgttgaaggccgcttcatggtcaagaccgttgaactcgccagagttgaacagcacgcctttttcagtcagggcttgctgagaaagatctggctcagagccgtcagctgccaggataaccggtttgatgttcaggccgtatttagaggcaaactcgtagtcgcgctggtcgtgccccggtaccgccataactgcgcccgtgccgtactccatcaatacgaagtttgctgcccaaacgggaatttcttcgcccgttaatgggtgaaccgctttaaagccagtatcgacgccttttttctccatcgtcgccatttcagcttcggcaactttggtgttacggcattcgtcaataaaggccgccagttcaggattattttccgccgctttctgcgccagcggatgacccgcagctaccgccaggtaggtacaacccataaaggtgtccgggcgggtagtgtaaacggtcagcgtgttgtcatagtcgttaacgttgaaggtgatctccacgccttcggaacgaccgatccagttacgctgcatggttttaacggtgtctggccagtgatccagtttatccagatcgttgagcagctcgtcagcgtaagcagtgattttgataaaccactgcgggatctctttacgttcaactttggtatcgcagcgccagcagcagccgtcgataacttgttcgttcgccagtacggtctggtcgttcgggcaccagttgaccgcagaagtcttcttatataccaggccttttttatacagctcggtgaagaatttctgttcccaacggtagtattccggcgtacaggttgccagctcgcggctccagtcataaccaaagcccagcattttgagctggtttttcatatacgcgatgttgtcgtacgtccacggtgccggagcggtgttgtttttcaccgccgcgccttccgcaggcagaccaaacgcgtcccagccgatcggctgcaggacgtttttgcccagcatacgctggtagcgggcgatcacgtcaccgatggtgtagttacgtacgtggcccatgtgtagtcgaccagaaggatagggaagcatagacaggcagtaatacttctctttgctctcgtcttcggttacttcaaatgtgcgcttctcatcccaatgaagctgtactttggattctatctcttccgggcggtattgctcttgcatggcagccagtggtcctgttttcaatacggctacaaatgtagcgttgaggtggtttttcagatccgcatagcatagcccaaacgtccgcgtcaaaacagcctttcgcgcactcgacgttgaaatgatgcccggattattcatacattaatttacagagtttgtgggcgtattagcaaagcaaggaacaaagaacgtctattattatagtcagttaacgacccgggagatgaaacgatgaacaaggttgctcaatattaccgtgaactggttgcgtcactgagcgaacgcctgcgcaatggcgaacgtgatatcgacgcactggtggaacaggcgcgcgagcgcgtaataaaaacaggggagttaacgcgaaccgaggtcgatgagctgacgcgagctgtcagacgtgacctggaagagttcgccatgagctatgaagagagcctgaaagaagaatctgacagcgtctttatgcgggtgattaaagaaagcttgtggcaggagctggcagacatcaccgataaaacgcagcttgaatggcgcgaagttttccaggacctcaatcatcatggggtttatcacagcggagaagtggtcgggctgggaaatctggtctgcgagaaatgtcacttccatctcccgatctacacaccggaagtgctgacgctatgcccgaaatgtggtcatgaccagttccagagacgcccgtttgagccgtaatagtctgatttcgcacagcaataaagagaatatgggccgaatgaaattccccggcccttgtttttatctctacagtaaatcttcagtctcacgaatttcctgactgacatctctggttccggatgactgaactttacgatacaggtcgagagcctgtcggagatcgacaggtcttccttctccgtagtgatacataatggccaggttataccaggcagtggcgtcattgcattcagcggctttcgtaaaccattcaaaggcagcctgataatctttctcaacgccttgtccgtgtttatacatataaccgatgttgacgtaagcgccgacgctcccctgagcggcagccttcagataccagtacatcgcttgcttatagtcctggtccaccccttcgccagcgttataatcccatgcaatttgaaactgggcgtgccgattaccctgctgtgcgcttttcaaataccagaatgcggcgagtgtcttgttttgagcaacgccttttccgtcttcataaagatcggccagattgttttgcgcgtcactatggccttgtaatgcagcttgtttgtaccagaaaaatgccagcgcatagtcttttgcgactccgttgccatttctgtacatccacccaagattattttgcgcataagacattccgctctccgcggctatctgataccagacaaccgcttctttataattgggggcttctccacgatccagtgtccagccaagggcgttggaagcgaaagtatggccttgtagggcagcttttttcagccagaagatggcttgctcattatctttatgacggcttttatcctcggtatacttttgccctaaggaatactgtgcttcacaatgaccttgctcagcggccagcttcagccagtaaaaggctttttcgtcgtccggagaatcaattgcgctatcgcgattataataaaacccaacaatatattgagcctcgcaatcgcctttttcagcacgttcgataatctcatctattgataaattatcgcagcaacttgacgtgaaaatcattatcatttccttatggttgcagataaaacatattatatttttatgtgttccatttttgcgtaagccttattttatgcgtattatgtcgcgtcagaaaagtataaataaacgagcctcgcaatgcggctaatattcatttaatgaatatttaaggataaattatatggacatggagtcgcaaaaaatattgtttgcactttccactccgatggaaatacgcaatgaatgctgtttaccttcgcattcatcacccaaaatgtatttaggtacatgcttttttgacctttcttcctcatggggaattgatgaccgtgatgacctgctgcgcacaattcaccgaatgatcgataacggtcatgccgctcggttggcagggttttatcaccgctggtttcgttattcgccatgtgaatggcgtgactatcttgctgaactaaatgagcaaggtcaggcttatgcgcaatttgtcgccagcaccgccgaatgctgtggcgaagggggaatcaaagcctgggattatgtccggatgggttttttaagccgaatgggcgtacttaataactggttgagcgaagaagaaagtctatggatccagtcgcgcattcatctacgggctctacgttattatagtaactggcggcaatactttgccggttatacctttggtcggcaatattggcagtctcccgaagatgatcatctgcctttattacgcgaattcttagcgcgtaaagaatacgacgattccggcaatgatatgttttatcaattatttgccagtgatgatgcgtattaccctaccttgtcctggcaaccattggcttactattctgcatgcccggaaacgcttaaggatatgagcgacctatgaaaaattgctggaagatcctcgatatagaggaaacgactgacgtcgatattatccgccgcgcttatctggcgctgttaccgtcctttcatccagaaaccgatccgcagggttttaaacaacttcgtcaggcgtatgaggaggcgctacggattgcgcagtcgcctgctaaatctgtttggcaaccagaagaatatgaggtagcagaacatgaaattctgctcgcctttcgtgcgttacttgcctctgatagtgaacgttttctgccctccgcctggcagcgattcattcagcaattaaattattgctcgatggaggagattgatgaattacgctggtcgctgtgcacaatcgccatgaacactgcccatttatccttcgagtgcgtggtgttattagcagaaagattgcggtggttacaggaggaaaataccggggaaatagacgaagaagaactggaatcctttttatatgccattgcgaaggggaatgtttttaacttccagaccattctgcatctgcccgttgccgtgcaaaatgacaccatcgatttttaccaaatgttcgctcggatttggtcatcgcatccacaatggctgacattgtatttagcgcaacatcgcgcagtgattatccccgatgatgcaaaactgcacagaaatttactccgctggtatagcgcaggtcgcctggatatccccgaacttctggattacgcccagtcatggcgggaaactgaacctgataatgaagatgcgccttattatgaatacgcgcaacgcgtctattgtggagaaggcgaaagcctgttggcagaactttgtgactactggcgcgagtatccctccacccaggcggatgctttaatgttgcaatggtgccgtcagcatcgggtcgattattacccattactggtgatgatgattgaagcgcgtgatctggttaacgatcagggaaaaccgctactttatgtccccggcgacagcgcccgtacgcgttttcatttatacgaaatactcagcgatgaaaaactctctgcgctggggcgttcactggtcgagatggttttgcacaaaggacgtaagccgcggatctcactcacgcgtgatacagaacataccttatggccattatatctagttgccaaacaattagtgcaggcctgccaacctacagaagaatcattaatgccgattgtgagccgccttgatgcagaaaatcgttgtccactggaagcattaattattcgtcgattattaattcaggcggcgaattttaccgagaagcaaactgttgaaccggagccgcaaccgcagccaatgcccgttgacgatggtgggccaggctgtctgggcatcattaaaattattttctatatttttatctttgctggtttgatagggaaaatactccatctgttcgggtgacagtcgacgttaatgtgcgggaagcccggcaagtaatctttccgcatttttgtaatgttgtttggcggtcagttttaaccatttttgagattcataatggttaacattaatacctgagccatttctgtagatcaaacctaaagtatattgagcatgagcatacccttgttcagctgcttccttataccagagaattgctttacgggtgtcgggtttgacccccagacctttgaggtagatccaccccagtttactttgcgcgcgtggattttcctgttccgctgattgctcataccagtatctcgcctgtgtataatccagtggtttaccgtcgctaccatgaagataaaattctccaaggcgatattgcgacgttgagtgaccatgaatcgcggaaagctccgtggctgccgtggtgaatggaagactgcccggtgagcttaaataatcaaaggcataattcaccatggctttatcacgcaacgtcgttttcttgggttggctaatacaggtaattgctgcaactataaaaattgcgaatatatacattaattttttattcatgtgtgaatgcttcgattttctttttattttgaaagcgtcaagtttatactcatcaataataaaaaagtagtcagttaatgcacttaagggattattaacaaatgaataaggaagaacaatatcttctttttgcgctttctgcgcccatggaaatacttaatcagggttgcaaacccgcgcatgactcgccaaaaatgtatactgggataaaagaattcgagctctcatcatcctggggaataaataatcgtgatgatttaattcagactatttatcagatgactgatgatggtcatgccaatgatttagctggcttatatctgacatggcatcgctcttcccctgaagagtggaaagcattaattgctggtggctcggagagagggttgatttatacccaattcgttgcccaaaccgctatgtgctgtggggaagggggaatcaaagcctgggattatgttcgaatggggtttctgtcacgggtcggtgtgctcaacaagtggctgacggaagaagagagtttatggctgcaatcgcgcgtctatgtacgagctcaccattactatcacagctggatgcactatttttccgcctattcgttaggacgtctctactggcaatcttctcagtgcgaagacaacacttcgctacgcgaggcgctaaccctgtacaaatacgatagcgccgggagtcgtatgttcgaagagctggcagcgggaagcgatcgtttctatgccacgcttccctggcagccattaactgtccagtctgaatgcccggtaacgcttaaggatgtgagcgacctatgaaaacatgttggcaaatcctcgaaattgaaagcacgacgcaaatagacattatccgccaggcttatcttgctcgcttaccgttgtgtcatcccgaaaccgatccgcaagggtttaaagcattacgccaggcctatgaagaggccctgcgactggcggtaaatcctgtcgaggaagcagatgatgaagaaaaagatgctgccgctgaacatgaaatactacgtgcattcaggacattactggattcagaaagtgatcgttttcagccttccgcctggcagaaatttattcagcaattaaatacctggaacatggaggatgtcgatcaattacgctggccgctgtgtgcaatcgccatagaagcgcgatatctttcattaaattgtgcttctttgctggcagagcgtttgaactggcattcatttaatgacagcgaaggaatggatgaggaagaaagggaggcttttcttgaggccattcaggctggtgattgtttcgatttccttagccttctggaatatcccattgcgttgcagaaccagactgttgagtattacttcgcgctggaacgttgctgccgttaccatcctgactatgtcactgcgtttttggcgatggaaggtccgtggttaattcctgatgatgcaaagttacatcgcaaactgttgcgctggtacagctcggtgcaaacaggtatggcggaactcattcctgtcgctcaacagtggcaaacggaagaaccagaaagcgaagatgcccggtattacttgtgtgcacaacgtttgtactgcggcgagggggaaagcctgcttgccgatctctgcgcgtactgggaaagttacccatctacacaagctgataatttgttgttgcagtggagcaagcgtcattgcccggattatttcgcgttattagtgatggttatcgaagcgcggagcatggtagatgcgcaaggtcaaccgctgaaatatgttcctggtgagagcgcccggacgcggctgttatgggcggagattttacatagcggaaaattatcgccgttaggtcaatcgtttattgagtcgttattcttcaagcgcaaagcatgggcgtggtggaaatcgagagtcggtagcgagacagagcaagattcaccgttcctggatttgtatcgggtagcggaacaggtagtacttgaagcgtttccgaaacaagagatgctggcccgtcttaatacaaggctggaaggcggagatgctcatccattagaggccattgtcacccggatgcttttgacgaaagtgaaactcgagccggaggatgaagatgtcgatgagccaacacctgaaaatcatgaagaaaaaaatgatgagggtgaaaaaccacagagcattaccagcattatcaaaatcagtttaacggtgctggtgataggttatgctctcggcaaaatcgcgatgttgtttagctgacgatgtgttttttgcgccgatgccggatgcagcgtttacgccgcatccggcagccgtgtttatgggatctcaatggctaaataatcgctcgcccgccgccgaacttcatccacgcgggccatatcgtttgactgcaacgccgcatcaaaatcggtgatcacccggccgatctcttctcgctcgtcacccagcgcccgcgcccacaactcttccagtttggctttaaaggtgcgattgatgagcatatcgcgcggataaattttcaatgcggataaccgcgtccgactctcttcaatctgctgcgcgctcaatgttaccgggctgtggttaatcactctggacttaacgctgccgtcttccagaagcacgtcaacttcaagcaacccgttgatatcataactaaagcgaatatcaatcgactgataagccccggttttcttcaacggcacatcgaaggattccaccagaatgttgtttttaactttgtggttttctccctgatagacgttaaccgtaattgaatcctgttccgggtgcatggttgaataagtttctacacgcgacacgggcacagtggtgtttcgttcaataatcggcgagaaaatgccggaaacgccctggcggttaacttcaacgcccaacgagtaagggcaaatatcagtgaggattacctcttcaatatcttcactgcgtaagcggcaggcggcctggattgctgcgcccagcgcgacaatggtgctcggatcgtaactttgatacggtaatttgccaaacagacgcacggcgattcgctgcaccagcggcatttgtgacgcgccgccaaccagcaccagactgtcgatttgactcggcttcagacgcgcatcgcgcaacgcctgttcaatcggcactcgcaagcgattgagcagcggcaaccacaaatcttccagttcgttctcgtaaaattcgcattcccgcgtttcttcctgatactgccagcgaatgtgcaatggcgattgattgctacattttgccgcttccacacaggcgtacaaggctgccagttcactctcgttaagcgtggtcctggcgacatccgcgcgttttaaaacctcatcgaccagcatatgggtaaaatcttcgccaccaagaaagttgtcgccagcggaggcgtgaacttcaatcaccggcgtggcgtactcaagcaccgtaacgtcaaacgtgccgccaccgagatcaaacaccagcgaacgggtattttgttgggtatgcaggccatacgccatcgcagctgctgtgggttcattaattaagcgtaccgcatttaacccggctaactccgctgctaaacgggtatgcttgcgttgttcatcgctgaaataagccggaacggagatcaccacatctttaatcggacgttgcagaaattcttcggcatcttcttttaatgagcgtaataccaaagaggacagttctggcgcgttaaatgtgtcgctgcctaaccgccagttggtattactgcccattgcacgtttaaataacgctgccgttttatccggatgcgaagtacgccgtgatacagccggttttccgactaaaatatgattattttcatccatgctaattatggatggtgttaaatattcaccgaacttatttggaattaattgcgcggcaccgtctttccagacggcaattaaactattggtagtaccgagatcgataccaatggcgagttctgcattatccattgcatttatatcttgaaagaaaaagagataaacagattaagaccacccaggtaacgcgtggtgatcttaatcaatgacgtgtgttaagcgtaaaatttcagacgatcagccagtaaatcaacaaagccctgacgatcaacatcgaccattacggtggcattcggtttattgcctgtcagataataataatcaacaaccgtcataccctgggtatatttcccctgtgtttccacgccaacccagcgctcaacagaggtaaataactccggtttcaacagccaggcgatggtgcatgggtcatgcagtggtgcgccgacaaagccccatttttcgtctttatgatattcgaggaagaaatccagcagttcggcaacaatggttgaaacagggttaccaatcgcgcggaaacgctcggtgtcttcaacgtggatttgtgctttatgagtaacatccagaccggccatcaccaccgggatccctgactggaagacaatttctgccgcttccgggtcaacgtaaatattaaattcagccgcaggcgtccagttacccagccccatagcgccacccataatcacgatacgggcaattttgctatgcagttccggatggctattgagcagcaaggcaacgttagtttgcggtccggtagacacaatggtgacaggttccgcactttcacgcagcgttttcgccatcagctctaccgccgtacagttttgcggtgcgaatgtcggttccggtaatgccgggccgtcgagaccgctttcgccgtgcacattgtccgcgataatcaactcacgcattaacggttttaccgcgccgcctgctaccggaatatcggtgcgattaagcaaggtcagcatacgcagaacattgcgtaaggttttttctggtgtctggtttccggcggaagacgtaattgctttgacatcaagctctggtgaggcgagggcgagaactattgcgatagcgtcgtcatgacctgggtcgcaatctaacagaattggcagtgccattgttgctccttgttgtgtgcttctttgcgacaagggtaacgccaggatgtaacagatacgaggggcgaaacgataaagcgtgagatggcgcgcaattgggtatgcgcgccagagtgattaatgcaggattttcgcgaggaagtcttttgcgcggtccgatttcggatcatcgaagaaagcgtctttcggcgagtcttcgacaattttaccctcgtccataaagatcacccgattcgccactttacgggcaaagcccatttcgtgggtcaccaccatcatggtcattccttcgttcgccagttccaccatcacgtccagtacttcgttgatcatctccggatccagcgccgatgtcggttcgtcaaacagcatcgcaataggatccatacacaacgcgcgagcgattgccacacgctgctgctgaccgccggaaagctgcgccggaaacttattggcgtgagcagaaagcccgacacgctccagcagtttcagggctttttcacgagccggcgctttatcgcgtttaagcactttcacctgcgccagggtcaggttttcgataatcgacagatgagggaacagctcgaaatgctggaataccatcccgacgcgggaacgcagctttgccagatcggttttcttgtcgttaaccacgataccatcgacggtgatttcaccttgctgcaccggttcgaggccgttgacggttttaatcagcgttgatttgccggaaccagacgggccgcaaaccaccaccacttcgccttttttcacttcggttgagcagtcggtcagcacctgaaagtgaccataccattttgaaacatttttcagggtaatcattatgctgtccttcttttcaagtagctgaccaacaacgacgcgctaagactaataacgaaataaacaaatccggcaaacaggatcatctcaacctgcgtaccatcacgctcaccaatggttgaggcggtacggaagaaatcggccagggataacacatacaccagtgaggtatcctggaacagtacgatgccctgagtgagcagcagcggcaccatcgcgcggaacgcctgcggcagaataatcagtttcatcgactgccagtgagtcattcccaacgccagcgcggcgctcgattgaccacgagaaatactttgaataccagcacggataatctctgaatagtaggccgcttcaaacatcgaaaacgccaccatcgccgaaattaaacggatatcattttttggcgataatcccagcacgttttgcagaaaacccggcacgatcaggtaaaaccacagcaaaaccataactaaaggaatcgagcggaatacgttaacgtaggctttggcaaaccacgccacgggcgcaaagctggataaacgcatcaccgccagcatcgtgccccacaaaataccaatcactaccgccgtgacggtgattttcagggtgatcaccagcccgtcgagcagatatggcagggaagggacaatggaactccagtcaaactcgtacattatttgccccccatgttgccaggcaggcgaactttacgttcaaccagcgtcatcaccagcatgataaaagcgttaatcaacacatacgccagcgtaatggcggtaaacgactcccaggcatgggctgagtaatcgagcaatttacccgcctgcgccgccatatccaccagaccgatagtcgaggcgatggcggagtttttcaccaggttcatcatctctgaggtcatcggcgggacgataacgcgataagcattaggcagcagtacgtatcgataagcctgcggtagcgtcaggcccatcgccagcgcggcatttttttgccctcgcggcagcgactgaatcgcggcgcgtacctgttcgcaaacacgggcggcggtaaacagccccaggcagagcatggatgaaaggaaaaactgaatattgggatccagctcggccttaaaccacatgccgattttctccggcagcagctccgggatcaccagataccaggtaaagaattgcacaatcaacggcacgttgcggaacagttcgacatacaacgtacccagaccagagagaaaacggtttggaacggtacgtaaaatgccgaaaaatgaaccgacgaggaaagcgataatccaggcgcagatcgacaaagcgatcgtcacctgaaaaccactccagatccaaccaagataggtggtgttgccgaacggggcttgttgtaaaaaaataccccagttccagtctatagacataaatctactccagaaaaaagagggtagcagcgttaactgctaccctcgaagattgttacccagcgtattgcggttttcaggcccgatggggaacgaccatcaggcgtatagtctgtccgtgctacgtaacaatcgagagggctggaatttccgcccctggttcttgtaattagttcagtgccttgtcattcggttctttgaacagtgctttcatttcgtctgacagttcgaaattcatgttcaggtttttcggcggaattggatttttgaaccacttatcaaaccatttttccgcttcaccggaggtctgcacctgagcgatggtgtcatccatcagctttttgaactgcggatcatctttacgcaacatacaaccgtaggcctcctgagactgcggcttgccgacgatttcccagttgtctggtttcttcgctttcgcacgttcaccggccagcagagcgtcatccatcataaaggcaacggcacgaccgctttccagggtgcggaaagagtcaccgtgatctttggcgctgatgatgcgcatattcattttttgctcttcattcagtttgttgagcaaaacttcagaggtagtgccggaagtgacgactacggctttgtctttcaggttggcaaaatctttgatatcgccaccctttttggtcaacaggcgcgtaccgaccacgaaaatagtgtcagagaaagccgcctgtttttggcgttcgacgttgttggtggtagaaccacattcaaaatcgaaagtgccgttttgcagcagtggaatacggttttgtgaggtaatcggaatcagttttacctgcaagtccggtttgttgagtttctttttcactgcttcaacaatggcgttggagtaatcctgcgagtaacccaccactttttgctgattgtcgtaataagagaaaggcactgaagattcacggtgaccgacgacaatcacaccgtttttggcgattttgtccagagtactgcccgctgccggggcggcgtcatctgcctgtgccagtcctgcggaaagcgccagggcgaggattgctgtggcaggtttacgtaattgcatatccaactcctttatcttctgcgttaagaacgcatggatacccgttgtgagtgtttgtgttgttatcgtctgcaactttattgtgcagtgttgtgcctgttagggaaggtgcgaataagcggggaaattcttctcggctgactcagtcatttcatttcttcatgtttgagccgattttttctcccgtaaatgccttgaatcagcctatttagaccgtttcttcgccatttaaggcgttatccccagtttttagtgagatctctcccactgacgtatcatttggtccgcccgaaacaggttggccagcgtgaataacatcgccagttggttatcgtttttcagcaaccccttgtatctggctttcacgaagccgaactgtcgcttgatgatgcgaaatgggtgctccaccctggcccggatgctggctttcatgtattcgatgttgatggccgttttgttcttgcgtggatgctgtttcaaggttcttaccttgccggggcgctcggcgatcagccagtccacatccacctcggccagctcctcgcgctgtggcgccccttggtagccggcatcggctgagacaaattgctcctctccatgcagcagattacccagctgattgaggtcatgctcgttggccgcggtggtgaccaggctgtgggtcaggccactcttggcatcgacaccaatgtgggccttcatgccaaagtgccactgattgcctttcttggtctgatgcatctccggatcgcgttgctgctctttgttcttggtcgagctgggtgcctcaatgatggtggcatcgaccaaggtgccttgagtcatcatgacgcctgcttcggccagccagcgattgatggtcttgaacaattggcgggccagttgatgctgctccagcaggtggcggaaattcatgatggtggtgcggtccggcaaggcgctatccagggataaccgggcaaacagacgcatggaggcgatttcgtacagagcatcttccatcgcgccatcgctcaggttgtaccaatgctgcatgcagtgaatgcgtagcatggtttccagcggataaggtcgccggccattaccagccttggggtaaaacggctcgatgacttccaccatgttttgccatggcagaatctgctccatgcgggacaagaaaatctcttttctggtctgacggcgcttactgctgaattcactgtcggcgaaggtaagttgatgactcatgatgaaccctgttctatggctccagatgacaaacatgatctcatatcagggacttgttcgcaccttccttaggtaacatttagtttggctaaatgtaaagatattgctgttttattgtttgtttttgcgagatgcgccgcaccattccgaagcaaaattcttaaaatgcactcttttagtgctaccgctggattactgtggtgcaactaggttgtactgatgctgtttcagggtttgccttgtataacaaagcaatagatgtgccaaagttggataggagaatattgttatccggataatgcactgatgccgcatccggtgagcgtgccgaaatatgggatgtattccggcacgataagaagggattatttacgtcgctgacgcagactcatcaacacagcagcaaaaccaaacaatgccgtcagcacccacagcggccagttgccggtacgtgcgtatggtgtgagtccggtggtcggcgtcacgttagtggttaacacctcgcgggtgaactgcgggatcatcgcctgaatctcaccctgcgggccaatcaccgccgtaatgccgttgttggtgctgcgcaacagtgggcgcgccagctccagcgcacgcattcgcgccatctggaagtgttgccatggaccaatagatttaccaaaccacgcatcgttggagatagtcagcagatagtcggtatccgggcggaagttatcgcgcacttgctcgccgagaatgatctcgtagcaaatagccgcagtaagctcaataccatttgccgacagcggcggctggatatatggcccacggctgaacgacgacatcggcagatcaaagaacggtgctaacggacgcagaatcgactccagcgggacaaactcgccaaacggcaccagatggtttttgttatagcgatcggctgattcgtagctgtacggcgcacctttacccagcgtgatgatggtgttgtaggtatcgtagcggttctgcttattgagacgcgcgtcgacaatcccggttaccagcgagctacctttatcacgcaactcaccgtccagtgctttgaggaacggttgctgattaatttccagatcggttatcgccgactccggccagataatcaacgatgatttgcccatcagcggtgccgttgcgttgtagtaaatcttcagcgtattaagaagctggccttcgtcccatttcagcgattgcggaatatcgccctgaaccatcgaaacctgaatggttttctccggttgtggggtaaaccactggatgtaacgcagcgggaagggaagggcaaacagcacgacggccaccaccagcggacgccagttgcgtttgaccaacgccagtgccagcaggccactaaccatcatcagcaggaagttaatggcttccacgcccattatcggtgccagcccttttaacgggccatcaatctggctatagccgaactgtaaccacgggaagccggtcagtacccaaccgcgcagaaactcggtcacttgccagagggcaggggcggcaatcgctacgcgcagccaggtggttttcggccacagacgcgacagcacgccagcaaacagtccggtatacagcgacaaatacgccgccagcagcaccaccaggaagatgttaaccgggccaggcattccgccaaaggtcgcgatgctgacatagacccagttaataccgctgccaaagaggccaaatccccagcaaaagccaatagcggcagactggagtggacggcggttaaaggtcaacgcctgaagccccatcagcgaaataatcgccgcaggccagacgtcgtaaggagagaaggccagcgttccgcaggcaccgaataataacgccagcagcaggcgaatgcgctggcgttcaattaatgaggcaaaagccatgtagttatctatccagtttcggttttattcatccagcttcggctggggtgagtcatccgggattttgacatgaacctgaataatacgccgactgtcggccatcgccactttgaactggtaaccgtcgatgtcgatagtttcgccacgcgccggaagatgcccaaatgcctgcatcaccagaccaccgatagtgtcgacttcttcatcgctaaagtgggtgccgaacgcttcgttgaagtcttcaatggaagccagtgcgcgtacggtccaggtatgacgactcagctgacggaagtcgatatcatcttcttcgtcatactcgtcttcaatctcaccaacaatcagttccaggatgtcttcaatggtcaccagaccggaaaccccaccgaattcgtcaataacgatcgccatgtggtaacgctgagagcgaaactctttcagcatccggtctacgcgcttactttcaggaacgacaaccgcctgacgtaacactttgtccatgctgaaggcttcagcatcgctgcgcataaacggcagcaagtctttcgccatcagaatcccttcaatgtgatctttgtcttcgctaatcaccgggaaacgtgagtgggcggactcgatgatgacatcaagacattcgtccagcgtctggttgcgtttcagggtaatcatctgggagcgggggatcatgatgtcgcgaacgcgttggtctgcgatgtccatcaccccttcgagcatatcgcgcgtatcttcgtcgataaggtcgttctgcccggaatcacggatcagcgccagcagttcgtcacggtttttcggttcaccgtggaaaagttggctgagtaacagggagaaaaatcccttcttgttgcttatcgtgtcactactgtgtgaattgtcgtcgctcatggcgtcgtatgggttctcatgttagttaatcaaaacgccgtcgttaatcaccaacggcggggacgtctgccagtcaaatgcctggcaaattattctttctcggcaatgtacggatcctcatagcccagagcaagcataatctctgtttcgagggcttccatttcttctgcttcgtcatcttcgatgtgatcgtaacctaacaaatgcagactgccgtgcaccaccatatgcgcccagtgcgcctccagtggtttgccttgctcctgagcttccttctcaaccacctgacggcagataaccagatcgcccagtagcgacatttccatgccaggcggcacttcaaacgggaaggagagcacgttggtcggcttatccttaccgcgataggtcagattcagactgtggctttcggcggtatcgaccacgcgaatcgtcacttccgattcttcctgaaactgcgggatcaccgcattcagccatgtctgaaactggctctcttccggtaacccggaattatcttcacatgccagttgtaaatcgaggatcacctgactcatttttgttcctgttcttcgcgcttgcgttctgctgccagcgccgcttttcgtttttgttcggcttcttcccaggcttcataggcgttaacgatacgcgccaccacagggtgacgaaccacgtcttcgctgtggaagaagttaaagctgatctcttcgacatcggccagcacttcgatggcgtgacgtaagcctgatttagtattacgcggcaggtcgatctgtgtgacgtcgccggtgataaccgcttttgagttaaaaccgatacgggtcaggaacatcttcatctgttcgatggtggtgttctggctctcatcgagaatgataaacgcgtcgttcagcgtacgaccacgcatataggccagcggtgcgacttcaataacgttgcgctcaatcagtttctcgactttctcaaagcccagcatttcaaacagcgcgtcgtacagcgggcgcagatacgggtctactttctggcttaaatcgccaggcaggaagcccagtttctcaccggcttctactgccggacgagtcagcagaatacggcgaatttcctgacgctccagggcatcaactgccgcagccactgccaggtaggttttacccgtacccgccgggccaacgccgaaggtaatgtcatggtcgagaatattggcgatgtactgcgcctggtttggcgtgcgcggcttaattacgccgcgtttggttttgatattgaccgctttgccgtactccggcacgctctccgcgctttgctccagtacccgcgcttctttaatcgcaaggtggatctgttccggttcgatatcctgaatctgaccgcgcatcggggcagtatcgacatacaggctacgcagaatgtctgccgcagcggtgacgcaaatcggacggccggtcagtttaaagtggttatcgcggcgattgatctcgatgccgagacggcgttcgagctgcttgatgttgtcatcaaacgggccgcacaggctcaacagacgcgcattgtctgctggctccagggtgatttcgcgagtgtctatgttcaaaccgttcctcttatctgtatgccgccggaagctgaacattcaccggcctataaggaaattattcacgccacaggaaaaaggcgcaagcattgcaataaagatggggataaagagagaaaaaacaaggcccaccggaacggcaggcctgagaattacggctgataataacccacgccaaggtcgttttctttgcgggtacgggcaatcactgattccggtgtttctgccacgcgcagacccatttcatcttcagtacgcaccactttaccgcgcagagagttcgggtagacgtcggtaatttctacatcgacgaatttaccgatcatatccggcgtgccttcgaagttgaccacgcggttattttccgtacgcccggaaagctccatgatgctcttacgcgatgtaccttctaccagaatacgctgggtggtgccgagcatccggcggctccacgccatcgcttgctgattaatgcgctcttgcagaatatacagacgctgcttcttctcttcttccggaacatcatcaaccatatcggcggctggtgtacccggacgtgcagagaagataaagctgtagctcatgtcgaaattgacgtcggcaatcagcttcatcgttttctcgaagtcttcggtggtttcgccagggaagccaacgatgaaatcagaactgatctgaatatctggacgcgccgcacgcagtttacggatgatcgctttgtactccagcgccgtatgggtacggcccatcaggttcagaatgcgatcggaaccgctctgtaccggcagatgcaggaagctcaccagctccggcgtgtcgcgatacacttcgatgatatcgtcggtgaattcgatcggatggctggtggtaaagcgaatacgatcgatcccgtcgatcgcagcaaccagacgcagcagatcggcaaacgatccggtggtgccgtcgtagttttcaccacgccaggcgttcacgttctgaccgagcaggttgacttcacgcacgccctgagccgcaagctgggcaatctcaaacagaatatcgtcggacggacggcttacctcttcaccacgggtgtaaggcaccacgcagtaggtgcaatatttattgcagccttccatgatggagacaaacgcggtcggcccttcggcgcgcggttccggtagacggtcaaacttctcgatttccgggaagctgatatctacaaccgggctgcggtcgccacgcacggagttgatcatctccggcagacggtgcagcgtttgcggcccaaaaataatatcgacatagtgggcgcgctggcgaatgtgctcgccttcttgcgatgccacgcagccaccgacgccgataatcaggtctggattcttctcttttaacagtttccagcgacccaactgatggaagactttttcctgagccttctcgcggattgagcaggtgttcagcagcagcacatccgcttcttccgccacgtcggtcagttgatagccgtgggtggcatccagcagatcggccatcttcgatgaatcgtactcgttcatctgacagccccaggttttaatatggagttttttggtcatcgacttgctcttgcgaaatagtagccaggaatgcagggcgcatagtgtaatgctttgctgccgttgtgaccagtatgagcgttatcagcccttaggggtaaaaatcctgtaaacttaaagcatattgctaacaggatgattgaccatgacaaatcaaccaacggaaattgccattgtcggcggaggaatggtcggcggcgcactggcgctggggctggcacagcacggatttgcggtaacggtgatcgagcacgcagaaccagcgccgtttgtcgctgatagccaaccggacgtgcggatctcggcgatcagcgcggcttcggtatcattgcttaaagggttaggggtctgggatgcagtacaggctatgcgttgccatccttaccgcagactggaaacgtgggagtgggaaacggcgcatgtggtgtttgacgccgctgaacttaagctaccgctgcttggctatatggtggaaaacactgtcctgcaacaggcgttgtggcaggcgctggaagcgcatccgaaagtaacgttacgtgtgccaggctcgctgattgcgctgcatcgccatgatgatcttcaggagctggagctgaaaggcggtgaagtgattcgcgcgaagctggtgattggtgccgacggcgcaaattcgcaggtgcggcagatggcgggaattggcgttcatgcatggcagtatgcgcagtcgtgcatgttgattagcgtccagtgcgagaacgatcccggcgacagcacctggcagcaatttactccggacggaccgcgtgcgtttctgccgttgtttgataactgggcatcgctggtgtggtatgactctccggcgcgtattcgccagttgcagaatatgaatatggcacagctccaggcggaaatcgcgaagcatttcccgtcgcgtctgggttacgttacaccgcttgccgctggtgcgtttccgctgacgcgtcgccatgcgttgcagtacgtgcagccagggcttgcgctggtgggcgatgccgcgcataccatccatccgctggcggggcagggagtgaatcttggttatcgtgatgtcgatgccctgattgatgttctggtcaacgcccgcagctacggcgaagcgtgggccagttatcctgtcctcaagcgttaccagatgcggcgcatggcggataacttcattatgcaaagcggtatggatctgttttatgccggattcagcaataatctgccaccactgcgttttatgcgtaatctcgggttaatggcggcggagcgtgctggcgtgttgaaacgtcaggcgctgaaatatgcgttagggttgtagccttacaacattgccggatgcgtgccaaccgtaggtcggataagacgcggcagcgtcgcatccgacattgaaggataagacgtgtcaacatcgcattcgacattgaatgaacgcagaaaagcaaaaagctcgccgaagcgagcttttttaatgtggctggggtacgaggattcgaacctcggaatgccggaatcagaatccggtgccttaccgcttggcgataccccaactgggtgcacttacaaggtaagcgtcttgaataaattggctggggtacgaggattcgaacctcggaatgccggaatcagaatccggtgccttaccgcttggcgataccccaacaaattggttttgaatttgccgaacatattcgatacattcagaatttggtggctacgacgggattcgaacctgtgaccccatcattatgagtgatgtgctctaaccaactgagctacgtagccagattgtttcttcgatggctggggtacctggattcgaaccagggaatgccggtatcaaaaaccggtgccttaccgcttggcgataccccaataaccgggcggtgaaccgcttactcgaagaagatggctggggtacctggattcgaaccagggaatgccggtatcaaaaaccggtgccttaccgcttggcgataccccatccgtacaacgctttctggtgaatggtgcgggaggcgagacttgaactcgcacaccttgcggcgccagaacctaaatctggtgcgtctaccaatttcgccactcccgcaaaaaaagatggtggctacgacgggattcgaacctgtgaccccatcattatgagtgatgtgctctaaccaactgagctacgtagccatcttttttttcgcgataccttatcggcgttgcggggcgcattatgcgtatagagccttgcagcgtcaacctctttttcaaggaaaattgctcgaaagtgactgtttggttaggttgcgaacagcgtggcgctatattcgtcaattattgtttactttgtgttttttcccaccctacagccattcttttgtcatacaggatgaaattcggaatttaacaatagtggtgggaaattaatctatgaaatactggcctacagtgatgagttgtcaaacagtgatgtggcaaacccggaacatttccttactgcatatcagaatcaacaagcacctcaataactgaaacagccccggatttcaccggggctgtttcgcatttcttacttatacgccgactggtgaacaccaaccgcgcgaccagacggatcgtccattttcttgaacgcttcatcccattcgatcgctttagcggaagaacaagcgacggaaggaccgcccggcacgcactcagcggcgctcggaagcgggaatagttcttcaaagatctcccgatacaagtacgcttctttagaggttggcgtgttgtacgggaagcggaagcgggcagtttccagttgctgatcagaaacctgctgcgcagccacttctttcagggtgtcgatccaactgtaaccgacgccatcggagaactgctctttctgccgccaggccacgcttgcaggcagatacgcttcaaaacattcacgcaggatgtgtttttccattttgccgttaccgcacattttatcctgtgggttaatacgcatcgccacatcaaggaattttttgtcgaggaacggaacgcgtgcttccacgccccaggctgacatcgctttgttggcacgcgcgcagtcatacatatgcagggccagcagtttacgcaccgtctcttcatgcagttctttggcattcggtgctttgtggaagtaaagataaccgccgaacacttcatcagaaccttcaccggacagcaccattttaatgcccatcgccttgatcttacgcgacattaaatacatcggtgttgaagcgcgaatagtggtcacatcataagtttcgatgtggtaaatcacgtcgcggatggcatccagaccttcctgtacagtgaagtgaatttcgtgatgcaccgtgcccagatggtttgccacttcctgggctgctttcagatccggtgaacccggcagacctacagcaaaggagtgtaactgcggccaccaggcttcagagcgttcctgatcttccacgcgacgggctgcgtatttcttggtgatagcggaaataattgaggaatccagaccaccagaaagcagcacaccgtaaggcacatcagacatcagatggcttttaactgaatcttccagtgcctgacgcagctcgtttttgtcggtcacgttatctttcaccgcatcgtagtcgaaccagtcgcgatgatagtaagaacggatttcgccgtcctggctccacaaatagctccccgccgggaactctttaatcgtgcggcaaactggcaccagcgctttcatttctgaggccacatacagctgaccgtgttcgtcataccccatatacagtgggatgatccccagatggtcgcgaccaatcaggtaggcatctttttcgctgtcgtacagtgcaaaggcaaacatgccctgcaagtcgtcgagaaattccggccctttttcctgatacagcgcgaggatcacttcacagtcagacccggtctggaactggtaacgatcgccatattcggcgcgcaatgcctggtggttgtagatttcaccgtttaccgccagtacgtgggttttttgttggttgtagagaggttgcgcccccgcgttaacgtcaacaattgacagacgttcgtgggcgagaatggcgttatcgctggcataaataccggaccagtccgggccacgatgacgcatcaggcgtgacagctcgagggctttcttacgcagctcaactgcgtctgttttgatatcgaatacgccaaaaattgaacacataaccttctccgttaacctggtatttgttgcttgttgtgtttgcttgtttaaaaaaatgccgcaaagcagcactgtgcgcaagcgatttggcggtgaaaaaataaaaaacgtaatggtgattgtcgattggtgaaaaaaggtctggtgtgaggatatatttattgatgaatcgataatttttagcgggttttattgaatgtttatattttacgggggccaaattgctgacaaagtgcgatttgttcatgccggatgcggcgtgaacgccttatccggcctacaaaagcatgaaaattcaatatattgcaggagctgcgtaggcctgataagcgtagcgcatcaggcagtttggcgtttgtcatcagagccaaccacgtccgcagacgtggttgctattcagataacgtcgatttcagcgactgacgggtaaatccagctggggcggaaaggcatactgtcgatatcgtcgagcgacgaaacaccagaaagcaccagaatcgtctccagacctgcctggaagccggccagaatatcggtacgcaggttatcgccgacaatcaccgtttcttccgaatgcgcctgcattttgtttaatgctgcgcggatgatccacgggctgggcttaccaacatagaacggtttgcgcccggagattttctcaatccctgcacacaacgcgccacaagcgggataaaaaccgcgcccgtgggtgtccggattggtggcgataaaacgtgcaccgttagcgacgaaataggctgctttatgcatcatgtcccagttgtaggaacgcgtttcgccaacaatcacgaaatcagggttcacatcggtaatagtgaaaccggctttgtacagttcatgaatcagtgcgccttcgcccaccacatacgctttcttgccttcctggcgacgcaggaaatcggcagtcgccatcgcagaggtataaaacacgctgtcaggtacatcgacacctgcggtggcaaagcggttcgccagatcttgcccagtctgcgaaggatagttggtcagcaacaccagcggcaggcctttatccataatcccgtgcaaaaattccgctgcacccggtacggcgacgttatcgtgcatcagcacgccgtcgatatcgcaaattacatttttaatggtcatggactacccagaatattgacaacaataagcgccactataaaagcacattaattttccagcaaatgctggagcaaaataccgttgagcatggcgcgttttaccagcgcaaaagcgccgattgccgagcggtgatccagctcagaacgtaccaccggcagattagtgcgaaacgccttcagcgcctgggtattaatgcagctttcaatagcagggagcagcactttatcggcttcggtgatttcaccggcaataacaattttttgcggattaaataagttgatagcaatggcgatggttttacccagatgacgaccgacatactcaattacttccgacgccagactatcgcctttgttcgcggctttgcagatagttttgatggtgcagtcgtccagcggcacgcggctctggtagccctgctttaacagattcaacacccgttgttcaatggcagcgttggcagcgatagtttccaggcagccaaagttgccgcagtggcagcgttcacccagcggttcgacctgaatatggccaatttcaccgacgttgccgttgcggccaataaaaatgcgcccgttagagataatcccggccccggttccgcgatggacacgcaccagaatggagtcttcgcaatcctgacttgcaccgaagtagtgctccgccagcgccagactacggatatcgtgaccaacgaaacaggtcactttaaaacgttcttccagagcttctaccagcccccagttttctacctgaatatgcggcatgtaatgaattttgccgctgtccgggtcaacaagccctggcaggatcaccgaaatcgcgatcagctcgcgcagtttgcgctggtagctatcaataaactgagcaatggcattcaacagggcatgttccagcgtttgctgggtacgttccggcagcgggtaatgttcttctgccagcactttgctgctgagatcaaacagagtgatggtggcgtcatgacgaccaagccgtacgccgattgcgtggaaattgcgggtttcggtgacgatggagatagcgcggcggcccccggtggaggcctgctgatcaacttctttgatcagcccgcgttcgataagctgacgcgtaattttggttacgctggcgggggcaagctggctttgctcggcaatctgaatccgcgagattggcccgtactggtcaatcaggcgataaaccgccgcgctgttaagctgttttacgagatcaacattacctatctgagcttgtccgcctggtgtcatactttctcttattgagttacgacctcgttaccgttaacgatggtcttggtgattttaaaatcaggtgtgaatgcagtcaggttggctactttacctgcggcgagtgtgccgagacgtttctcaacgccaatcgcacgcgccggatagagcgtcgccatacgtagcacttcatccagtgcgataccgcaatgttcgaccagattacgcacgccttcaatcatggttaaggatgaaccgcttaacgtaccgttctcatccacacaaagtccgttacggtagtatattgttttacccgcaaaaatgaactgttcaatgttggcacctgctggcgcggtggcgtcagtaaccagacacagtttgtcgcctttcagacgtttagcgttgcgaatgttggcgtaatcaacatgcaggccatcagcaataataccgcaataaatgtcagcttcgtcgaggatcgcgcccgccaggccaggttcacgaccggtaatatacggcatcgcgttgtacagatgggtggcaaaggtaatccccgcgcggaaaccggcttttgcttctttcaacgtcgcgttggagtgaccggcagaaaccacaatcccggcatttgccagtttgctgatgacttccgcaggaaccatttccggtgccagggtcactttggtaatgacgtcggcgttttcacacaggaaatcgaccagcgcggcatcaggcttacgcacaaaattcggattatgggtgcctttttttaccagattcagccacggaccttccagatgcagacctaacgcctgattcggatgttttgccaggtactcgcgcataacgcgcacgccctgtttcatcagctcatcgctggtggtgataagcgtcggcagatagttagtacagcctgatttctcattggctttctgcatgatttccagcgtttccacgctgaccgcttcagcggtgtcgttaaactgtacgccgccgcagccgtttaactgcacatcgataaaaccgggggagagaatggccccgttcagtgaacgttgttcgatctctggcggcagttccgctaccggacagacgcttttaatcaggccatcagcgataacaaccgcgtggtcatcaagaaattcgtggccggtaaagatccggccctgggttaatgcatacattctgacccccgattttaaaaaatattgccctgagcaaggagccagggcagggataacaattacagacctttgatattttctgcttctaattcattgaaatatcttaaagtcttaactttcagctccatggtggaaggttcatcgcacaccatgatcgctttcggatgcagttgcagacagctgatggtccacatatggttcacgcaaccttcaacggcggcctgcagcgccagtgctttctggctacccagcaccagaatcatcacttcttcggcatccagcagtgtaccaacaccgacagtcagggcatattttggcacctgattaacatcgttatcaaagaaacgagagtttgcgacgcgagtgtcatgagtcagggttttgatacgagtacgagaagccagagaagacgccggttcgttaaatgcaatatgaccgtcgttacctacaccgcccataaacagatgaatttttccgtaagaacggattttttcttcatactggcggcactcggcgtcgatatccggggcgttgccgttgagaaggttgatgttttctgctggaatatcaacgtgatcgaagaaattacggtgcataaagctgtagtagctttccggatgctctttcggcagaccgacatattcgtccatgttgaaggtgacaacgtgcttaaagctgacctggcctgctttatgcatttcgactaacgctttataggtggtcatcggcgtgccgccagtcggcaggcccagtacaaacggacgatcggcagtcggtttgaacgcattgatacgattgacgatatggcgagcagcccatttgccgacctgttcagcggtagtcagggggatcagtctcattattcacctcaataagtaaaatgtaagccgttggcggattaggcatctttaagcgtaacctggatttgcgcagacaggcgtcaatccgacctgattttttgaatgataaaataagttttctggtttagccagtaaaagggagtgataataacgatatttggtgacaaaactcacaaaagacacgcgtttaatttgcgatacgaattaaattttcacacactctgtagcagatgatctaacaatctgattacagaacatcggcagtacaatttgcagcaaaataaaaatacggcttgaaacgagccaaatagggttctcgtagggggaataagatgaatattttaggttttttccagcgactcggtagggcgttacagctccctatcgcggtgctgccggtggcggcactgttgctgcgattcggtcagccagatttacttaacgttgcgtttattgcccaggcgggcggtgcgatttttgataacctcgcattaatcttcgccatcggtgtggcatccagctggtcgaaagacagcgctggtgcggcggcgctggcgggtgcggtaggttactttgtgttaaccaaagcgatggtgaccatcaacccagaaattaacatgggtgtactggcgggtatcattaccggtctggttggtggcgcagcctataaccgttggtccgatattaaactgccggacttcctgagcttcttcggcggcaaacgctttgtgccgattgccaccggattcttctgcctggtgctggcggccatttttggttacgtctggccgccggtacagcacgctatccatgcaggcggcgagtggatcgtttctgcgggcgcgctgggttccggtatctttggtttcatcaaccgtctgctgatcccaaccggtctgcatcaggtactgaacaccatcgcctggttccagattggtgaattcaccaacgcggcgggtacggttttccacggtgacattaaccgcttctatgccggtgacggcaccgcggggatgttcatgtccggcttcttcccgatcatgatgttcggtctgccgggtgcggcgctggcgatgtacttcgcagcaccgaaagagcgtcgtccgatggttggcggtatgctgctttctgttgctgttactgcgttcctgaccggtgtgactgagccgctggaattcctgttcatgttccttgctccgctgctgtacctcctgcacgcactgctgaccggtatcagcctgtttgtggcaacgctgctgggtatccacgcgggcttctctttctctgcgggggctatcgactacgcgttgatgtataacctgccggccgccagccagaacgtctggatgctgctggtgatgggcgttatcttcttcgctatctacttcgtggtgttcagtttggttatccgcatgttcaacctgaaaacgccgggtcgtgaagataaagaagacgagatcgttactgaagaagccaacagcaacactgaagaaggtctgactcaactggcaaccaactatattgctgcggttggcggcactgacaacctgaaagcgattgacgcctgtatcacccgtctgcgccttacagtggctgactctgcccgcgttaacgatacgatgtgtaaacgtctgggtgcttctggggtagtgaaactgaacaaacagactattcaggtgattgttggcgcgaaagcagaatccatcggcgatgcgatgaagaaagtcgttgcccgtggtccggtagccgctgcgtcagctgaagcaactccggcaactgccgcgcctgtagcaaaaccgcaggctgtaccaaacgcggtatctatcgcggagctggtatcgccgattaccggtgatgtcgtggcactggatcaggttcctgacgaagcattcgccagcaaagcggtgggtgacggtgtggcggtgaaaccgacagataaaatcgtcgtatcaccagccgcagggacaatcgtgaaaatcttcaacaccaaccacgcgttctgcctggaaaccgaaaaaggcgcggagatcgtcgtccatatgggtatcgacaccgtagcgctggaaggtaaaggctttaaacgtctggtggaagagggtgcgcaggtaagcgcagggcaaccgattctggaaatggatctggattacctgaacgctaacgcccgctcgatgattagcccggtggtttgcagcaatatcgacgatttcagtggcttgatcattaaagctcagggccatattgtggcgggtcaaacaccgctgtatgaaatcaaaaagtaatctgctttatgcctgatgcgacgcttgagcgtcgcatccaacaatgacaagcggtggagatcttctctgccgctttttttttcatcaatcatccccataatccttgttagattatcaattttaaaaaactaacagttgtcagcctgtcccgcttataagatcatacgccgttatacgttgtttacgctttgaggaatccacgatgagtgaggcagaagcccgcccgactaactttatccgtcagatcatcgatgaagatctggccagtggtaagcacaccacagtacacacccgtttcccgccggagccgaatggctatctgcatattggccatgcgaaatctatctgcctgaacttcgggatcgcccaggactataaaggccagtgcaacctgcgtttcgacgacactaacccggtaaaagaagatatcgagtatgttgagtcgatcaaaaacgacgtagagtggttaggttttcactggtctggtaacgtccgttactcctccgattattttgatcagctccacgcctatgcgatcgaactgatcaataaaggcctggcgtacgttgatgaactgacgccggaacagatccgcgaataccgcggcaccctgacgcaaccgggtaaaaacagcccgtaccgcgaccgcagcgttgaagagaacctggcgctgttcgaaaaaatgcgtgccggtggttttgaagaaggtaaagcctgcctgcgtgcgaaaatcgacatggcttcaccgtttatcgtgatgcgcgatccggtgctgtaccgtattaaatttgctgaacaccaccagactggcaacaagtggtgcatctacccgatgtacgacttcacccactgcatcagcgatgccctggaaggtattacgcactctctgtgtacgcttgagttccaggacaaccgtcgtctgtacgactgggtactggacaacatcacgattcctgttcacccgcgccagtatgagttctcgcgcctgaatctggaatacaccgtgatgtccaagcgtaagttgaacctgctggtgaccgacaagcacgttgaaggctgggatgacccgcgtatgccgaccatttccggtctgcgtcgtcgtggttacactgcggcttctattcgtgagttctgcaaacgcatcggcgtgaccaagcaggacaacaccattgagatggcgtcgctggaatcctgcatccgtgaagatctcaacgaaaatgcgccgcgcgcaatggcggttatcgatccggtgaaactggttatcgaaaactatcagggcgaaggcgaaatggttaccatgccgaaccatccgaacaaaccggaaatgggcagccgtcaggtgccgtttagcggtgagatttggattgatcgcgccgatttccgcgaagaagctaacaagcagtacaaacgtctggtgctgggtaaagaagtgcgtctgcgtaatgcttatgtgattaaggcagaacgcgtcgagaaagatgccgaaggtaatatcaccaccatcttctgtacttatgacgccgataccttaagcaaagatccggcagatggtcgtaaagtcaaaggtgttattcactgggtgagcgcggcacatgcgctgccggttgaaatccgtttgtatgaccgtctgttcagcgtgcctaacccaggtgctgcggatgatttcctgtcggtgattaacccggaatcgctggtgatcaaacagggctttgctgaaccgtcgctgaaagatgcggttgcgggtaaagcattccagtttgagcgtgaaggttacttctgcctcgatagccgccattctacggcggaaaaaccggtatttaaccgcaccgttgggctgcgtgatacctgggcgaaagtaggcgagtaattttaagtttcgctatgccggatggggcgtttacgtcgcatccggcaaggaacagacaaacagtttcaaacgctaaattgcctgatgcgctacgcttatcaggcctacatgatctctgcaatatattgagtttgcgtgcttttgtaggccggataaggcgttcacgccgcatccggcaagaaacagcaaacaatccaaaacgccgcgttcagcggcgttttttctgcttttcttcgcgaattaattccgcttcgcaatttatccataaaataaatttaaaataacaaaacataattaaataaaatgtaaccgctttcatcttgctggaatttcacgcttttattcttctgcaagcctttcaaccgcaaacttaagccttgtaacaaaaatcatcaaaatatgtgcggttgctcatgttcttacattctggttacagaaagagattgataattcgcgtcgcgaaaaatagtctgttcctgtagtcagcgagacttttctcaacgctacttttttaatttttattttttcgctgttcacctttggtgcagcaatttatacgtcaaagaggattaacccatgcgtacgtttagtggcaaacgtagtacgctggcgctggctatcgccggtgttacagcaatgtcgggctttatggcaatgccggaggctcgcgccgaaggattcatcgacgattcaaccttaaccggcggtatctattactggcagcgtgaacgcgaccgtaaagatgttaccgacggcgacaaatacaaaaccaacctttctcactccacctggaatgccaacctcgattttcagtccggttatgctgctgatatgttcggccttgatattgctgcgtttacggcgattgaaatggcggaaaacggcgacagctcccacccgaacgaaatcgcgttttcaaaaagtaataaagcctatgacgaagactggtccggcgacaaaagcggtataagcctgtataaagctgcggccaaatttaaatacggtccggtttgggcgagggcaggttacattcagccaactggtcaaacgctgttagcgccgcactggagctttatgccaggtacttatcagggggcggaagccggggcgaattttgattacggcgatgctggtgcgttgagtttctcctacatgtggaccaacgaatacaaagcgccgtggcatctggaaatggatgagttttatcagaacgataaaaccaccaaagttgattatctgcactcctttggggcgaaatacgacttcaaaaataacttcgtactggaagcggcatttggtcaggcggaagggtatatcgatcaatattttgccaaagccagctacaaatttgatatcgccggtagcccgttaaccaccagctaccagttctacggtacccgagataaagttgacgatcgcagcgtcaacgacctttatgacggcaccgcctggctgcaagcgttgacctttggttaccgggcggctgacgtagtggatttgcgcctcgaaggcacctgggttaaggctgacggtcagcagggatacttcctgcaacgtatgactccaacctacgcttcctcaaacggtcgcctggatatctggtgggataaccgttctgacttcaacgccaacggcgaaaaagcggtcttcttcggtgcgatgtatgacctgaaaaactggaatcttccaggcttcgccatcggcgcttcctacgtttacgcatgggatgctaaacctgcgacctggcagagcaatccggatgcgtactacgacaaaaaccggactattgaagagtctgcctacagcctggatgcggtctataccattcaggacggtcgcgccaaaggcacgatgttcaaactgcatttcaccgaatacgacaaccactccgacatcccaagctggggcggtggttacggcaacatcttccaggatgagcgtgacgtgaaatttatggtaatcgcaccattcaccatcttctgatgcccgacgcggcaggttttgtgcctgccgcacgtttgaggaatttgctatgaaaaaactgattctcatcgccataatggcatcggggctggtagcttgtgcgcaatcaaccgcgccacaggaagacagtcgtctgaaagaggcatacagcgcctgtatcaacaccgcacaaggttcgccagaaaaaattgaagcctgccagagcgtgttaaacgtgctgaagaaagagaaacaacatcagcagtttgccgaccaggaaagtgtacgcgtactggattatcagcagtgtctgcgtgcaacgcaaaccggaaatgatcaggcggtgaaagccgattgtgataaagtctggcaggaaatacgcagtaataacaaataagtgagagctgtaactctcgcttttcttatttcccttgcataaaaaagccaacccgcaggttggcttttctcgttcaggctggcttatttgccttcgtgcgcatgttcatcttcgcggcaatcgccttcggcacagtgaccgtaaagatagagactgtggttagtcaggcgaatgccatgttttgcggcaatttcacgctgacgcgcttcgatggaatcatcactaaattcgataaccttgccgcagtcgaggcagatcaggtgatcgtggtgatgttgctgtgtcagttcaaatacggatttaccgccttcaaaattgtggcgggtgacgataccagcgtcgtcaaactggttcagtacgcgatataccgtagccagaccaatttcttcacccatatcgatcagacgtttgtataaatcttccgcactgacgtgatggttgtccggctcctgaagaacttccaggatttttaaacgaggaagcgttactttcaggccagctttctttagggcggtattgttatcagtcatgcggaatctgtcctgttactaagcggttcacttcattagaagaagtgacagaatttgctcttgagataatgcgtatcattatagaattgccacgcctaaatgaaaaccacaagtccctggcaaatattgttaataaaaacgtggcacagcttacatttacaacggcaaggccacttgaacaccgggacattgtacaggtacaacagcaaaagttacaaatttgtagcaattattttgattggcattatctattaatacggcgtagacatgagtctacgccgcatcacatcaggcattgagaatttcgtcgagatgcaactcttcagaaatctgtttaacccatttttctacacgttcagcggtcagttccggctgacggtcttcgtcgatagccagaccgacaaagtggtcgtcatctgccagaccttttgatgcttcgaaatgatagcccgcagttggccagtgaccaacgatggttgcaccgcgcggttcaatgatgtcgcggatggtgcccaatgcgtcgcagaaatattcggcgtaatcttcctggtcaccacaaccaaacagcgcaaccagtttgccgttgaaatcaatctcttcgagagtcgggaagaagtcatcccagtcacactgcgcttcgccgtaataccaggttgggatgcccagcagcagaatgtcataagcttccagatcttctttgctgctttttgcaatgtcatggacatcggcaacgtctttaccaagctgtttttgaatcatttttgcgatattttcggtattaccggtgtcgctgccgaaaaagatgccagtgatagccatgagtgaaataacctcttgaaacttattgaaatgggggtggaaaattgcccacggataaaggcaatcatagcagaacaggcagtcttgcggaatcagcaaacgagcaggactgcacactgtgctacatgaaagtggaaatttaaacgatgccctgactacgcagcgccgccagttgctgcattaacatctcttcgatcagttcgctacggctcatattgcgcgactccgccagctcgttcagcgcctcgacagcttccgcgttcagcttcagttcgacacgcttaaggccacgtactttgtcgcgttttagctggttgcgtttattaatacgcagctgttcatcgcgcgaaagcggattagttttcggtcgtcccggtcgacgctcgtgcgcgaacagatctaatgtcgtacggtccgtttgttctttggccatgatcttggtgacttcgggggaaacaatcagccaggcctctgcccggatggatagcgcgccataatacatcagcgcgatgagtcacgccaacgcccacgcgcggaaagcgacgcggacgctgggtttttaatcagttgcgttaatcattgagatagcgacggatagcgcgtaataccgcatccggtttttcagcatggacccagtgacccgcgcctgcaatcacatgcgcccgtgcctgtggaaattgagccagtaaatcatcacggtactgctcgctaacatacggagaattgccgccagggataaacagggcagggtgatcccatgccgggattttctcccaacctacaatatgcggatactgatcccacaataccggcacgttaaagcgccactccccgtcaacaaaagatttcagcagaaactgaatcaccccttcttcattaagatgctggcgcattattgctgctgcttgctggcgagtttgtgcgtccgattcactgaccgcgttgatagccgcaaaaatctcatcatgacggcgtacgtgatagtcgaccggcgcgatatcgatcgccaccagtttatcgatgcgatcggaggctagtgcagtaagtgccattaccgctttaccgcccatggagtgaccgataaatgttgctttgtcgatctgctgtgcatccagagtatcaacaagatcctgcgccatcgccgggtaattcattaccggatctctcggtgaaagaccgtggttacgcatatcaacctggatgatattgtgatcgtttaccagatcgcgagccagtacgccaaggttgtcgaggctgccaaacagaccgtggacaagaacgatgggagaattattgtgctggttttgtgcagtttgcgcgcggatattcaatttcatggcaaagttctttttttcgcgttgtcgggttagggtattatgttgaccattgtgccacagggctgcaacaaataaggtttattccgagtttttctgcaagccaggcttgacgctatccgctgccgggatttattcatatactcctggcgacttgtattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaaaacgttgcagacaaaggacaaagcaatggcaatccacaatcgtgcaggccaacctgcacaacagagtgatttgattaacgtcgcccaactgacggcgcaatattatgtactgaaaccagaagcagggaatgcggagcacgcggtgaaattcggtacttccggtcaccgtggcagtgcagcgcgccacagctttaacgagccgcacattctggcgatcgctcaggcaattgctgaagaacgtgcgaaaaacggcatcactggcccttgctatgtgggtaaagatactcacgccctgtccgaacctgcattcatttccgttctggaagtgctggcagcgaacggcgttgatgtcattgtgcaggaaaacaatggcttcaccccgacgcctgccgtttccaatgccatcctggttcacaataaaaaaggtggcccgctggcagacggtatcgtgattacaccgtcccataacccgccggaagatggtggaatcaaatacaatccgccaaatggtggcccggctgataccaacgtcactaaagtggtggaagacagggccaacgcactgctggccgatggcctgaaaggcgtgaagcgtatctccctcgacgaagcgatggcatccggtcatgtgaaagagcaggatctggtgcagccgttcgtggaaggtctggccgatatcgttgatatggccgcgattcagaaagcgggcctgacgctgggcgttgatccgctgggcggttccggtatcgaatactggaagcgtattggcgagtattacaacctcaacctgactatcgttaacgatcaggtcgatcaaaccttccgctttatgcaccttgataaagacggcgcgatccgtatggactgctcctccgagtgtgcgatggcgggcctgctggcactgcgtgataagttcgatctggcgtttgctaacgacccggattatgaccgtcacggtatcgtcactccggcaggtttgatgaatccgaaccactacctggcggtggcaatcaattacctgttccagcatcgtccgcagtggggcaaagatgttgccgtcggtaaaacgctggtttcatctgcgatgatcgaccgtgtggtcaacgacttgggccgtaaactggtagaagtcccggtaggtttcaaatggtttgtcgatggtctgttcgacggcagcttcggctttggcggcgaagagagtgcaggggcttccttcctgcgtttcgacggcacgccgtggtccaccgacaaagacggcatcatcatgtgtctgctggcggcggaaatcaccgctgtcaccggtaagaacccgcaggaacactacaacgaactggcaaaacgctttggtgcgccgagctacaaccgtttgcaggcagctgcgacttccgcacaaaaagcggcgctgtctaagctgtctccggaaatggtgagcgccagcaccctggcaggtgacccgatcaccgcgcgcctgactgctgctccgggcaacggtgcttctattggcggtctgaaagtgatgactgacaacggctggttcgccgcgcgtccgtcaggcacggaagacgcatataagatctactgcgaaagcttcctcggtgaagaacatcgcaagcagattgagaaagaagcggttgagattgttagcgaagttctgaaaaacgcgtaaacacatttaataaaaaaagggcggtcgcaagatcgcccttttttacgtatgacaaacacagaattgcctgatgcgctacgcttatcaggcctacgaggatggtgcaatatattgaatttaagcgattttgtaggccggataaggcgttcacgccgcatccggcaaaaacaacgaacactttgtcaacaaactgagtagctcaaggaaatcccaatgaagaccaacaggagtctggtcgtcatagtgtcactaattaccgccacattactgctgactgcatgcgcccaacctgaacaatcatcattagctggcgactggttactgacccctaaagataaaaccagaggattaacgggtagcattgcggtaaatattgcacctttccggtgtaagacaaattgccgtggtgataacttacctgataatacccgccgctggcagttgtcaggcgggaacgaaaaagaacttacttatcttcataatatgtcagcacaagaaaaggtcggtttaaatcccggttggcaatgctacacctcattttttatgcgggtttgccagggcaagcccggcactcgaccgatagtcaatgaggattatgtcagcgaaagcggattttttggctcgatgatgcatgtcgggattattgagttacgacgctgccagtcagaaaattgccagcaagaattgaaagcgataaatacacattaaaatagtgagtccgggaatgaaacccggacctgaacatgtcttattgcgtgaatgtttctttcatttgatactgcatttcccagagttcagtaagcgaaataacttttcttgttcttgcttcttcactttgtacccataagaaagggtagaacgtgaaggcttccgttgccgataattttattacgtcttctcgccattgctgccatcgtacattttcatagaaggtatctaaatcaccggataatgcccactgaagaaactcagaatatccaacttccagactttcccaattcagcgtatctggcgcaaaataataaacgcagccagtatcttccccaagatcgccaccattaagagcaaaaattacccctgcgacatcgtcagcgatgggtaaagcccgcacgcctgcgaattcagggcgttgtgtccaacttactggatctcgtggcaaccgggggtgaccagatcctgctatgcgtaactaaccattatcaatcagcagacctccggagccatagacaagcgcacccatcggtgattttgttgtcacctgtaattgataaagtgcggtttcggctaaatctttattaaccggtaagagttcggtatggtttgtggcgtcttttaaccagttctggattattggccaggctgaatcttcagtatttactaactgattcatttcacgcatcgctacttgctccttgtgtgctacggtgtcatttatgatgaggaattgtatggaacattttttaaatattaagttccttatatttgaataaaaaatgactttatccatacattgccacttttttcaaagcataaaccgatacccaataccggtttcagtaataaaatggcgaggccgggccggatcctgttccagtttttgtcgcagatgccccatataattacgcaaatagttgctgtgttcgatcgcgtttagaccctacatctgccggatgcggcataaataacgaactatttgccaacaaacagaaagggcgatcattcaatcgcccttttttactttgttttattaaccgtgtttatttttcagttcaaagcgtggtgataccagaccatacagtgtccaaccaaggaaggtcacgatggaaccgtacagcatggcttcttccccggatgagtacagcgcataaaagctatacatcgcgccaacaaaagcaacaaagtttgcaactttcgcttttgaggggggcacattagcgaccttctgaataatgactaatgccgccattgacagaatatacggaatgatattggtcaccacggccaggttaaccagcacgttgaactgactgtttagcgacgggctaatggtcatcagtgccaatccactctgaataatcacaatggtcaacattccctgcaccggtgcatccactttggttacacgggagaaaattttagggaagtagccttcatcagatgaagatttaaacacctgggcaatggtgaactgccagccaagtagcgaaccgcagcaggacatcaccatcagcgccataatgactttacccacttccggcgtgaacatctgcgcgaaggccagaccaaatggtgccgttgaatttgccagctccatatttggcacaatcccggcaatcacgttggtggagacgatataaatcaccgccgcacctaacgtaccgccgagtaccgcgattggcacattacgttccgggttttccactacatcagtattcgcacacgcagactccagaccaagaaaagcccacagcgtcatagcgatggaagaacctaccgcactgaagaacggtgcatgatgcggattccaggaatcaacgtacagcgtcgggctaaaccagaaccagccaataatgcacagaccgacgaccggaataatgaccccccacacggtaatgctactgatttgcccggtaatgcgcgcaccaccaaagttagccacggtacaaatccacagcaccccgatggtcgcaagaccaatctgcactggcgacaaactcgcgccgagcagttcggtgccgtaaccaaccgccgaaatagcaatcgcgacgttagcaatcagcagtgagacgccgtaggtatagttcgccataaagttaccggatttaccgaaagcatactcggcataaccgcccataccgcctgatttacggctgaacataccgcattttgcgaatgcccatgccagtgccattgagcctacggctgtcaccagccaggagataattgagattgtcccgacttcggcaagctttgtcggcagcatgatgataccggagcccatcatgttgaccatcgtcagtatggttaactgaacgacgcccattttgttcgatttagcctgactcataatttttcccctttcaacagggtgctttgcgcatcacgaggcttgatgacatagcaccaaacttgcttacgaccatcatgttcttcgatatagacaccctgcagctccggtgcaaaacctggcagcaggttgatcccttcttccagagcgctgaagtaacgcagaacagcaccaccccagatttcacccggaacaacacacagcacacccggaggataaggaagcgcaccttcggcagcgatacggccttctgcatccggcagacgaaccagttccacttcaccgcgtaaataggcgtagttggcttcttgcggattcatgctgacgcgtgggaagtgctccttacggaacatctctttttgcagttgtttcacgttgtggcgggcatacaaatcatgcatttcctgacacaactgacgcagggtataaccggcgtagcgctcttcatgctgtttgtagatggaaggtagcacttctgctaatggcgcgtcggactcaagcagtttttcgaagcgtaccagcagggcaacaagttgctgaagtttggccatatcttctgccggagtcagcaggaagaggatggagttaagatcgcatttttccggcactacgccattttcgcgcaggaagttagcaagaatcgtcgcgggtacaccgaacgcttcatattcgccgttacgtgcatcaatacctggggttgtcagcaacagtttgcatggatcgacaaagtattgattctctgcatagccttcaaaagaatgccagtgttcccctggtacaaactggaagaagcgcagatcaaccgcaatttgcgctgtttcatacgactgccagggtttaccatccaccagttcaggtacgaacggacgaatatgctgacagttatcgaggatcagtttgcgggcattaatgccatttaccacacaatccatccacatattacgaccgctgacaccttcatgcattttggcgttgatattcagtgcggcaaacagcggatagaacgggctggtggaggcgtgcatcataaaggcgttgttcatgcgtttgtgcggtacataacgctgttgccctttgatgtggctgtcttttttatgaatttgtgaagtctgagaaaaaccagcctgttgtttatgcacagattgcgtaaccagaatacccggatcgttctcattaagatccagcaacagcggcgaacagtccgccatcatcggaataaactgttcatagccgacccatgctgagtcaaacaggatgtagtcacacagatgaccaattttatccaccacttggcgggcgttataaatcgtaccgtcgtaggtgcctaactgaatcacagcgaggcggaaaggacgagcctcttttgcccgctgcggtgcgacttccgcgatcagctcacgcaggtaactttcttcaaaacagtgcgcatcaatgccaccgataaagccatacgggttacgtgccgtttccagataaaccggtgttgcaccagcctgtagcaacgctccgtggtggttagatttgtggttattgcgatcaaacagcaccagatcacccggtgttagcagggcgtttaaaaccactttgttagaagatgaagtgccatttaaaacgaagtaggttttatcggcattaaacacttttgccgcatgttgctgtgcaatgcatggcgcgccttcgtgaatcagcagatcgcccatcgctacgtcggcgttgcacaagtcggcacggaacagcgcctcaccaaagtattccacaaactgattccccgccggatggcgacggaaaaattcgccgccctgatgaccagggcaatcaaacgcgctgttaccttgattgacataatcgaccagtgcgcggaagaaaggtgggcgcagttgagtttcataatggctggcagcggtttctaactggcgaccataaaattctcgtcgcgattcgcaattctcaaagacacccgaaatacggggcaaatactctgcgggtacacgttcttgattttcagtagcaataaataccgggatgccataacccgtggcatcgatttcatcgagttttccgcatgtaacatcgttgagcgataaaactattgccgccacatcgatattacgactttcattaatgtagatacattctcgctgcgtggtaaaacagtccgggcaagaatcactaaccgcaatttttaattttgacatttttcatctctttattttaggtaatagcaggtcctcaatttctcgaatgagaaatcgatcgtgccggaaaaaagcaaagttaccccgctgataaataaatcaggtagattgcttttttcagaatgcagaaacccttaccagtcaggtggctgataatacaagggttaacagagaatgagcactgcggaatacaggcatatgcctgtaatacagagagtcaggaagacctgtacgctgaagtgcccttagtcggtagactaacgggcattgaagaagtgaaagtcgaagctattgcgatgagcaaacttcataatatgagttgtccgccttatatggggcatagtgcggctgttattttccatttaatttacctttcctgatgtgaatgaaggtgaagatattctatccaggaaatacggttgaactgtgaaggtgatcaataaaaaatgatcaatcttaatttatttaatgatgagctttttactcagtaatataaaatattgaattgttatttttgtgtgttgtttaagataaaaagccgtatttattattacggctttaattaataaaaggcaggctgtattaaaattaatattcaaagcataaaccgatagccaataccggtttcagtaatgaaatggcgtgggcgggcgggatcctgttccagtttttgtcgcagatgtcccatataaatacgcaaatagtgactgtgttcgaccgcgtttggcccccacacctggttaaggagctggcgctgggtgagtacttttccggcattgttgagcagcaccgccagcaggcggaactcaattggtgtgagatgcacctcttcctcaccccggtgaatcacgcgggcggctaaatcgacggtaacatcggaaaattttaccagcggatcgggcgcggtggtggcagagtggcggcgtaatgcgacgcgcagacgggcctgcaattcgccaatgccaaacggcttactcagataatcatccgctccggcatccagcgcggcgattttgtcgctctcttcgctgcgtgcggaaagcacaatcaccggcaccgcgctccactggcgcaggtcgcggataaactcaatcccatcaccatcgggcaggccgagatcgagaataatcaaatctggcttacgggttgccgcttccagcaagccgcgttgcagcgtttcggcctcaaagacgcgcatcccgtcgccctccagcgccgtgcgcagaaagcgacgaatagcctgttcatcttcaacaatcagaacgtttgtcacatatcctcatgaaattcttcaagttcaggggcagtttgctggggaagtgtaacacgaaaacaggcaccaccttccggtcggttgaacgcggtaatagtgcccccgtgtacatccactatcgcccgacaaattgccagtccaagccctacccccggtactgccgactctttattcccgcgagcaaacttatcaaatatcgtctgctcctggcctggcggaagaccggggccgttatcccagacatccagttgtagattttcgccctcaacgtgggcatcgataccaatttcggcctgcgcacccgcatatttcaccgcgttctccagcagattaatcagcacccgttcaaagagtggcccgtcaacgtggattaaggtcagcggttctggcagagaaagattgatgggcgacgataaacccggttccagcatttgcagcgcgctgccgactacttcttccagcgttaaccactctttcttcaaattaaagccgccggactgaattcgcgccatatccagtagattattcaccagtcgggtagtgttcagcacatgctgacggatctcgctggcctggcgggcgtggggtgatccttcgcttgccagatcgagcgttaagatttctgcctgaccaaacagcaccgtaagcggcgtgcgtaaatcatgcgaaagcgccgccagcagggcgttgcggatctgttcacgttcgcttgccatccgcgcctgttcttcgctggcggttagcgtcagccgctcaagggcattggcgactaacagcgtaaacgtctccagcaggcgctgctgttccgggatcatcaactggcgcagattccccggctccaccaccaccagcccgtaggttttctcgccgctttttagcggcaaaatctggtacggtacaccgggtaacgtgtcggtgcccgcgcccgcaggcaggcctttatcaaaactccactgcgcgatggcatcgtcccacggcgtcattccttgcggatgtgttaacggctgcaatttaccgttgtcatcgggcaacaacacctgactgcgggcatgaaacgtggaggcaataaattgttcgctggtggcagcgatatcctgcggactgcggcccaccgccagagctttcgacatttcatataagtgccgtgtgcgttgctcgcggtaacgggctacccgcgcctgataacgcacgccagcagtaaggttcccgatcaccagcccgacggttaacatcaccgcgaaggtcagcagatattgcacatcagagacggcgagcgtgccgcgtggggcgataaaaaagagatcgaaactcactacattaatgacggtggcaaccactgaaggccagcgtccataaaatagcgccaccaccaccacgccaagcagatacagcatcaccaggttggcggcatcaaacgccatcagccactgcatggcaattaaggtgataacggcgcataacgcggcggcaaccacgcatccctgaatttgtacacgccacttgtctttaaaagagcggttatccggcgcgttgttaatcgtgcgggcgggtggttcatcaagcgcgaccagcacctgatcgagatcgggggcgatgcgcgccagtcggtcagcaaacgtttcccgacgccaccagcggcgcgaggccgggcgaccgagaataatcttgccgagattatgttcacgggcataacgcactaccgctttctcttccgctggatcagaaagtgttgccgtctccgcgcccagttcctgcgccagacgtaaggcgctgagaattgcccgacgttttttttccggtaagcggtgcagggcaggggtttcaacatacaccgcgtgccagacgctacccagccgtgacgccagccgcgccgctgcgcggaccagtttttcgctgccggtgttatggccgatgcataaaaggatcgcgtcgcgcgtgtgccacactttctcttcgccaggatgcccccgccaggcgcgcatttgctcatcaacgcgatcggcagtacggcgcagtgccagttcgcgcagggcgatcagattacctttgcggaaaaaatgttcaatggcgcgctccgcctgcccggcaatatagactttgccttctttcagccgctggcgcagatcgtccgggggcaagtccaccagcaccacgtcgtcggcggcatcgaaaaaaggatcgggcacggtttcccgtacctgaattccggtgacgccgctgaccacatcattcagactttccagatgctgaacgttgacggtagtgaaaacatcaatgccagcttccagcagttcttcgatatcctgccagcgtttgggatgacgggaacctggcgcattactgtgcgccagttcgtccattaagatcagcgccgggcggcgggcgagggcggcatcgagatcaaactcgctgatatgccgcccacggtacgcctggcgttttaacggcagaacagccagcccttccagcatggcggcggtatcttttcgcccgtgggtttctaccacgccaaccacaatatccagcccttgcgcccgcagtcgctgggcttctgccagcatcgcccaggtcttcccgacgcctgcacaggcaccgaagaaaactttcagcttcccccgatgcggcgcggcagtttgttccagcagacgatcggggtcgggacgtaagggttcgttattcatcaagtttatccagcgccagattgagttcaacaatgttgacaaccggctggccgatatatttcaccagcggttgttggctgtattttgcgatcagttgcgtgagctgttcaacgctgagattacgcgctttcgccacgcgtgggatttgccaggccgccgcttgcggggtgatattattgtccagcccgcttgccgatgccgtcaccagttcaaccggaacgctcgcgctggcatccgggttagcggcccgtaatgcagcaacgcgtgcggctattagtttatccagctcagggttactgaccgccagattgctcccgccagaagcctgtggattatagggcatttctgccgttgccgacgggcgaccatgaaaatagccgttgccggtaaaattctgcccgattaatgccgaaccgcgcaccgtatcaccttcacgaatcaacgaaccattggcctgccagggaaaccaccattgccccagtacggtggtcagcagcgggtaaacgccgccagtaatcaataacagaaagataaatgttgataatgccggacgtaatccactcatggtaaacctcacaccagaccgcaaacggtcagcagtaaatcaatgactttgataccgataaacggcaccagcagcccacccagaccgtaaatccataagttacggcgcaacatggcagaagcggtaagcggtttataactcacgccttttaacgccaggggaatcaaaaagacgataatcaaggcgttgaaaatcaccgcactgaggattgcggagtcgggcgaatgcaggcacatgatgttcagcgcatttaactgcggatacgttgccgcgaatgccgccggaataatggcgaagtatttcgccacatcgttggcaatgctgaaggtggtcagcgagccacgggtcatcagcatctgtttgccaatgtgcaccacctcgatcaacttggtcgggttagagtcgagatcgaccatattgcccgcctctttcgccgcctgggtgccggagttcatcgccaccgcgacatctgcctgcgccagcgccggagcatcgttggtgccgtcgccggtcatcgctaccaaacgaccttccgcctgatactgacggatcaatgccagcttggcctccggtgtcgcttcggcgagaaaatcatcgacacccgcttccgcagcaatcgcggcggcagtcagacggttatcgccggtaatcatcaccgttttaatgcccattttgcgcagctgggcgaagcgctctttaataccgcctttgacgatatctttcagcgcaataacgcccagcacacgagaaccttccaccaccaccagcggcgtggctccctgacgcgcaacctgatcgactttttgatcaacatcggtagggaagtgaccaccgttagcctcaacatggcgacgaatggcatcgacagaacctttacggatcatgcggttgtcgatgttgatcccgctcatccggctttgcgcagtaaacggtacaaaggtggcatggagcgactgcacatcgcgctcgcgcaggttaaaacgctgcttggcgaggatcacaatactgcggccttccggcgtttcatcagccagcgaagccagttgtgcggcgtcagccagcgttttttcatccacgccctgcgcggggataaactccgacgcctgacggttaccgagtgtgatggtgccggttttatccagtagcagaacgtcaacgtcacctgccgcttcaactgcacgtccgctggtggcaatcacattcgcgcctagcatccggctcatcccggcgacgccgatcgctgacaacaggccgccaatagtggttgggatcagacagaccagcagcgccaccagtaccgttacgctgactgcattaccgccccacgcggaaaacggccacagcgtggcggttgccagtaaaaagacgatagtcagggcaatcagcagaatggtcagggcaatttcgttcggcgttttgcgtcgctgtgcgccttccaccatcgcgatcatccgatccagaaatgtctcgccggggttaacgctacactcaatcaccagccagtcagaaagaatacgcgtgccgccggtgacggaggcaaaatcgccgccggattcacggatcaccggtgccgattccccggtgatggcgctttcatcgaccgatgcacccccttcaataacttcaccatcgcaggggataatatcgccagcttctaccagtacgatatcgcctttacgaagttggtcggcaggaactttgtccgccgcagcgccatatttcggctcacgcagcttgcgggcaaaggcagtttttttcacccctttcagactgttggcctgcgctttactgcggccttctgccagcgcctcggcgaaattagcgaacagtacggtgatccacagccaaccgctaatggccgcgctaaacagcgcattgccgggcatcgcaccgcttgccatcgcgatgctaatacaggtggtcagcagactgccgatccagacgataaacatcaccggattgcgccattgcgcctgcgggtttaattttttcaccgcttctttcagcgcctgaacgacaagtgttggttcgaatagcgccagttgtttacgactcatattcagtgctcactcaatatcatcaggagagatattccgccaccggaccaagcgccagggcagggataaaggtcagtgcgccaaccagcaacacggtgccgattaacaggccaacaaacagcgggccgtgcgttggcagcgtgccggagctggcggcttggctctttttactcaccagcgaaccggcaattgccatcaccgggataatcaccccgaagcgaccgacaaacatgcagaacgccagtaaacagttccagaacggagagttggcgcttaatccggcaaaggcgctgccgttgttgttagcggcggatgacacggcgtacagcacttcgctaaaaccatgcgggccagggttgagcatggcgctacgtccggcgtcggtcatcatcgccaacgccgcgcccatcagcaccagcgtcggggtaaccagaattgccagtgcagtcagtttcatctcgcgtacgtcgatttttttacccagatattccggtgtacgaccaatcatcagcccggcaataaacaccgccagcaggacaaacagcatcatgccgtaaagaccagaaccgacaccgccgaacaccacttcaccaatttgcatcagccacatcggcaccatgccaccgagagcggtaaacgaatcatgcatcgcaatcaccgcgccacaggaagccgccgtcgtcacgaccgcaaacaggctactgaccagcacgccgaaacggctctctttaccttccatattgatgctgctgtccgtgcccagtgccagcagatgaggattaccctgaacttctgcccacatcaccacgcctacgcagatgacaaaaatcactgacatcgcccacagcaacatgcgcccctggcggcgatcgcccatcacttcaccaaaggcaaagcacagcgccgttgggatcaagaagatcgccagcatctgcacgaagttggtcagtgcggttgggttttcaaacggatgcgacgagttggcattaaagaagccaccgccgttagtaccgagcatcttgatcgcttcctgagaagctacaggccccatgggtaacagctgttgcgctccttcaacggtattcacagcctgataaggcagaaagttttgcagcgcaccttgttgaataaaaaacagtgcaatcaacaacgccacagggactagcacccataacgtgatgcgtagcagatcgacccaggcattcccgagcgtgctcatgctctggcgggtaaacgcacggatgagggcaaaaatcaccgcaatcccgctggcggcagaaagaaagttttgcaccgttaagcccgccatctggctgaaatagctcaacgtggtttcaccgctataagattgccagttggtattggtgacaaagctgacggcggtattcagcgccagatcccacgacagccctggcaactgctgtggattaagcggcagatagtgctgaccgagcaacataaaaaacagcaccgccagccccagcatgttcaggccgagaatggcacaaagatattgcttccagttcatctcacggtcagagacgccaagtgcgcgaaaaagtacgcgctcaacgcccgttgtaccgggaagaggaatgtcattaatcagccgcgccagcccgctgcctaaaggacgcgccagcaccattaacaccagtaaaaacgtggcgatcagtaagaacccttgcgcagccatcagaacgcctccgcattgatcagggcataaaccagataacccagtaataaaaacaccagcaatacgccggttatcacgcctgcactcacagtgcacctccagtggcctaaaagtgataccggaagggtagaattctggctgcaaagatttcgcaaaaatctgcgggcggggtgtaaaaaaagtataaaaatggcaaaagccatgatttaactaatgtttagtattaatttaacttttgtgtaacttaattacaggatgaatgtaaataaaccatcaataagcaaaaataagtggtcggatgagtagtaaaattacacaaaaggcggtactattttcatcagataaacaaattcatttttccggtgccattcaccgggtagatacaaaagggggagaaaagtatggaactctacagagaatatcctgcatggcttatctttttacgccgtacttatgcggttgcagcgggcgttctggcgctgcctttcatgcttttctggaaagaccgcgcccgcttttacagctacctgcatcgcgtctggtcgaaaaccagcgataaaccggtgtggatggatcaggccgaaaaggcaactggtgatttttattgattgctgagttttgaatacattgaaaaccgccagcggaaacgctggcggttttttgtatcaggaagatgttcagaggaatatttagacatcgttataccaatcgaaacatatattcatgaaatatatataaatattttcctaattgttcttatctgacagatatctcacttaaggctttcttataaatctgtagggtttcgcctgtcagcagacaaataacccgataaaacaaggatgagcagatgagcggaaaaccggcggcgcgtcagggcgacatgacgcagtatggcggtagcattgtccagggttcagccggggtacgcatcggtgcccccaccggcgtggcctgttcggtgtgccccggcggggtgacgtccggccatccggtcaatccgctgctcggtgcaaaggtccttcccggtgaaaccgacatcgccctgcccggcccgctgccgttcattctctcccgcacctacagcagttaccggacaaaaacgcccgcgccggtggggagcctcggccccggctggaaaatgcctgcggatatccgcttacagctgcgcgataacacactgatactcagtgataacggcggcagaagcctgtattttgagcacctgtttcccggtgaggacggttacagccgcagcgagtcactgtggctggtgcgcggcggcgtggcgaaactggatgaaggtcaccggctggccgcactctggcaggcgctgccggaagaactccgcttaagtccgcatcgttatctggcgacaaacagtccgcaggggccgtggtggctgctcggctggtgtgagcgggtgccggaagcggatgaggtgctgcctgcgccgctgccgccgtaccgggtactgaccgggctggtggaccgcttcgggcgcacacagacgttccaccgcgaagccgccggtgaattcagcggcgaaatcaccggcgtgacggatggtgccgggcgtcacttccggctggtactgaccacgcaggcgcagcgggcagaagaagcccggcagcaggccatttccggcgggacggaaccgtccgcttttcctgataccctgccgggttacaccgaatatggccgggacaacggcatccgtctgtctgccgtgtggctgacgcacgacccggaatacccggagaatttacctgccgcgccgctggtgcgctatggctggacgccccgcggcgaactggcggcggtgtatgaccgcagcaatacacaggtgcgcagctttacttacgatgataaataccggggccggatggtggcgcaccgtcacacgggccgaccggaaatctgttaccgttacgacagcgacgggcgggtgacagaacagctaaacccggcaggcttaagttacacgtatcagtatgagaaggaccgcatcaccatcaccgacagcctgaaccgccgtgaagtcctgcacacgcagggtgaaggcgggctgaagcgggtggtgaaaaaggaacacgcggacggcagcgtcacgcagagtcagtttgacgcggtgggcaggctcagggcacagacggatgccgcaggcaggacaacagaatacagtccggatgtggtgacgggcctcatcacgcgcatcaccacgccggatggcagggcatcggcgttttactataaccaccacagccagttaacgtcagccaccgggcctgacgggctggaaatacgccgggaatatgatgaatggggccgtctgattcaggaaactgcccctgacggcgatatcacccgctaccgttatgataatccacacagtgacttaccctgcgcaacggaagatgccaccggcagccggaaaaccatgacgtggagccgttacggtcagttgctgagcttcactgactgttccggttatgtaacccgctatgaccatgaccgttttggtcaggtgacggcggtgcaccgcgaggaagggctgagtcagtaccgcgcatacgacagccgtggacagttaattgccgtgaaagacacgcagggccatgaaacgcggtatgaatacaacgccgccggtgacctgaccaccgtcattgccccggacggcagcagaaacgggacacagtacgatgcgtggggaaaagccatctgtaccacgcagggcggtctgacgcgcagtatggaatacgatgctgccggacgggtcatccgcctgaccagtgaaaacggcagccacaccaccttccgttacgatgtactcgaccggctgatacaggaaaccggctttgacggccgcacacagcgttatcaccacgacctgaccggcaaacttatccgcagcgaggatgaggggctggtcacccactggcactatgacgaagcagaccgcctcacgcaccgcaccgtgaatggcgaaaccgcagagcggtggcagtatgacgaacgcggctggctgacagacatcagccatatcagcgaagggcaccgggtgacggtgcactatggttatgacagtaaaggccgcctcgccagtgaacacctgacggtgcatcatccgcagacgaatgaactgctctggcagcatgagaccagacatgcgtacaacgcacagggactggcgaaccgctgtataccggacagcctgcccgccgtggaatggctgacctacggcagcggctggctgtcaggcatgaaactcggcgacacaccgctggtggagtacacccgcgaccgcctgcaccgggaaacgctgcgcagcttcggccgttatgaactcaccaccgcttatacccctgccgggcagttacagagccagcacctgaacagcctgctgtctgaccgcgattacacctggaacgacaacggcgaactcatccgcatcagcagcccgcgccagacccggagttacagctacagcaccaccggcaggctgaccggcgttcacaccaccgcagcgaatctggatatccgcatcccgtataccacagacccggcaggtaaccgcctgcccgacccggagctgcacccggacagcgccctcagcatgtggccggataaccgtatcgcccgtgacgcgcactatctttaccggtatgaccgtcacggcaggctgacagagaaaaccgacctcatcccggaaggggttatccgcacggatgatgagcgcacccaccggtaccattacgacagtcagcaccggctggtgcactacacgcggacacaatatgcagagccgctggtcgaaagtcgctatctttacgacccgctgggccgcagggtggcaaaacgggtatggcggcgtgaacgggacctgacgggctggatgtcgctgtcacggaaaccgcaagtgacctggtacggctgggacggcgaccgcctgaccacgatacagaacgacagaacccgcatccagacgatttatcagccggggagcttcacgccactcatcagggttgaaaccgccaccggtgagctggcgaaaacgcagcgccgcagcctggcggatacccttcagcagtccggtggcgaagacggtggcagtgtggtgttcccgccggtgctggtgcagatgctcgaccggctggaaagtgaaatcctggctgaccgggtgagtgaggaaagccgccgctggctggcatcgtgcggcctgacggtggcgcagatgcaaagccagatggacccggtatacacgccggcgcgaaaaattcacctgtaccactgcgaccatcgcggcctgccgctggcccttatcagcacggaagggacaacagcgtggtacgcagaatacgatgaatggggtaacctgctgaatgaagagaacccgcatcagctgcagcagcttatccgcctgccggggcagcagtatgatgaggagtccggcctgtattacaaccgccaccgctattatgacccgctgcaggggcgatatatcactcaggatccgattgggctgaaagggggatggaatttttatcagtatccgttgaatccgatctcaaatatagatccattaggattagaaacactaaaatgcattaagccactgcattcaatgggcggaactggtgaaagaagcggtccagatatatgggggaatccgttctatcatcaatatctttgtgtcccagatggtaaaggggactatacttgtggtggccaagaccaacggggagaatcaaaaggagatggtctatgggggccaggtaaagcaagtaatgatacaaaagaagctgctggccgttgtgacctcgttgaaaccgataatagttgtgtggagaactgtttaaaagggaagtttaaagaggtaaggccgcgttattctgtattgcctgatatattcacacctataaatttagggctatttaaaaactgccaagactggtctaatgattctttagaaacatgtaagatgaagtgctccggaaataacattggacgttttattagatttgtattcaccggagtgatgtaatgaaatatattatttttttattcagagctatatggctggctttatcgcttttaatactattcttttccatgcatagactttcactattagactccactcgtgatgtgagcgagttaattagtctcatgtcttatggaatgatggtaatatgttttccaacaggcatagtattctttattgctctaatatttatagggactgtatcagacattattggcgtaaggattgatagtaagtatattatggcgataataatatggctttattttctgtcaggagggtatattcaatggtttgtattaagtaagcgcattataaacaaataaattaagttaattgctcttattattatatgtaacctgggcattgatatcccgtatgccacagacccggcaggtaaccgcctgcccgacccggagctgcacccggacagcaccctcagcatgtggccggataaccgtatcgcccgtgacgcgcactatctttaccggtatgaccgtcacggcaggctgacggagaaaaccgacctcatcccggaaggggttatccgcacggatgatgagcgcacccaccggtaccattacgacagtcagcaccggctggtgcactacacgcggacacaatatgcagagccgctggtcgaaagccgctatctttacgacccgctgggccgcagggtggcaaaacgggtgtggcgacgtgaacgggacctgacgggctggatgtcgctgtcacggaaaccgcaagtgacctggtacggctgggacggcgaccgcctgaccacgatacagaacgacagaacccgcatccagacgatttatcagccggggagcttcacgccactcatcagggttgaaaccgccaccggtgagctggcgaaaacgcagcgccgcagcctggcggatacccttcagcagtccggcggcgaagacggtggcagtgtggtgttcccgccggtgctggtgcagatgctcgaccggctggaaagtgaaatcctggctgaccgggtgagtgaggaaagccgccgctggctggcatcgtgcggcctgacggtggagcagatgcaaaaccagatggacccggtgtacacgccggcgcgaaaaatccacctgtaccactgcgaccatcgcggcctgccgctggcgcttgtcagcacggaaggggcaacagaatggtgcgcagaatacgatgaatggggcaacctgctgaatgaagagaacccgcatcagctgcagcagcttatccgcctgccggggcagcagtatgatgaggagtccggcctgtattacaaccgccaccgctattatgacccgctgcaggggaggtatatcactcaggatccgattgggctgaaggggggatggaatttttatcagtatccgctgaatccggttcagtatatagattcaatgggactggcatcaaaatatggacacttaaataatggcggatatggagcgagacccaacaaaccgcctacgcccgatccaagtaaattgccggacatagcgaaacaattaagactgccatatcctattgaccaggccagtagtgcgcctaatgttttcaaaacattcttcagagcattaagcccttacgactacacactgtattgcaggaagtgggtaaaaccaaatctgacttgtacgccacaggatgattcccagtatccagggatggatacaaagacagcaagtgattacctgccacagacaaattggccaacaactcaattaccaccaggatatacttgtgcagaaccctatttattcccagacattaataaacccgatgggccagcaacagcagggatagatgatttgggtgaaattttagctaagatgaaacagagaacatcgagaggaataagaaaatgaaaagagttttgttctttttgctgatgatatttgttagttttggtgttatagctgattgcgaaatacaagctaaagatcatgattgttttactattttcgctaagggtactattttttccgcgtttcctgtcttaaataataaagccatgtggagatggtatcagaatgaggacatcggtgagtattattggcaaacagaactgggtacatgtaaaaataataaattcacaccaagcggggcgagactcttaattcgcgtcgggtcactacgccttaatgaaaatcatgccatcaaaggaacgttgcaggagttgataaatacagcagaaaaaacggcgtttctcggcgatcggtttagaagttatataagagcgggtatctatcaaaaaaagagcagtgatccagttcagttgttggcagtccttgataattcaatcatggtaaaatattttaaagatgagaaaccaacttatgctcgaatgacagcacatctcccgaacaaaaatgagtcttacgaatgtttaataaagatacagcatgaactaattcgtagtgaagagaaataaaatctcttcctgagaaaacaaattaatcattgtgaaaaattatataactcatggaataggtgtttattttgcgttccatttgcagggaaagatcacgtaacgctacttttttgtactaaataattcgaattttaagttcaacaattgagatactacttattgtctaaagctgtttttcatagcttatacatgatcaaatactccttacataaataaggtgaacaaatggaacttaaaaaattgatggaacatatttctattacacccgattacagacaagcctggaaagtggtgcataaattgtcagatattctactgttgactatttgtgccgttatttctggtgcagaaggttgggaagatatagaggatttcggggaaacacatctcgattttttgaagcaatatggtgattttgaaaatggtattcctgttcacgataccattgccagagttgtatcccagggaaagatcacgtaacgctacttttttgtactaaataattcgcattttatgtttaaaaattgagatattccttattacctaaagctgtttttcatagcttatacatgatcaaatactccttacataaataaggtgaacaaatggaacttaaaaaattgatggaacatatttctattattcccgattacagataagcctggaaagtagagcataaattgtcaggcatcctactattgactatttttgccgttatttctggtgcagaaagttgggaagatatagaggatttcggggaaacacatctcgatttcttgaagcaatatggtgattttgaaaatggtattcctgttcacgatactattgccagagttgtatcctgtatcagtcctgcaaaatttcacgagtgctttattaactggatgcgtgattgccattcatcaaatgataaagacgtcattgcaattgatggaaaaacgctccggcactcttatgacaagagtcgccgcaggggagcgattcatgtcattagtgcgttctcaacaatgcacagtctggtcatcgggcagatcaagacggataagaaatccaatgagatcacagctatccctgaacttcttaacatgctggatattaaaggaaaaatcatcacaactgatgcgatgggttgccagaaagatattgcagagaagatacaaaaacagggaggtgattatttattcgctgtaaaaggaaaccaggggcggcttaataaagcctttgaggaaaaatttccgctgaaagaattaaataatccagagcatgacagttacgcaatgagtgaaaagagtcacggcagagaagaaatccgtcttcatattgtttgcgatgtccctgatgaacttattgatttcacgtttgaatggaaaggactgaagaaattatgcgtggcagtctcctttcggtcaataatagcagaacaaaagaaagagccagaaatgacggtcagatattatatcagttctgctgatttaaccgcagaaaagttcgccacagcaatccgaaaccactggcacgtggagaataagctgcactggcgtctggacgtggtaatgaatgaagacgactgcaaaataagaagaggaaacgccgcagaattattttcagggatacggcacatcgctattaatattttaacgaatgataaggtattcaaggcagggttaagacgtaagatgcgaaaagcagccatggatagaaactatctcgcgtcagtccttgcggggagcgggctttcgtaatctttccctgctttttgtactaaataattcgcattttatgtttaaaaattgagatattccttattacctgaagctgttttttattgcttatacatgatcaaatacttcttacataattaaggagaacaaaatggaacttaaaaaattgatggaacatatttctattatccccgattacagacaagcctggaaagtggaacataaattatcggatattctactgttgactatttgtgccgttatttctggtgcagaaggctgggaagatatagaggattttggggaaacacatcccgattttttgaagcaatatggtgattttgaaaatggtattcctgttcacgataccattgccagagttgtatcctgtatctgtcctgcgaaatttcatgagagctttattaactggatgcttgactaccattcttcagatgataaagacgtcatcgcaattgatggaaaaatacaccggcattcttatgacaagagtcgccgtaagggagcgattcatgtcattagtgcgttctcaacaatgcacagtctggtcatcggacagatcaagacggataagaaatccaatgagatcacagctatccctgaacttcttaacatgctggatattaaaggaaaaatcatcaaaaccgatgcgatgggttgccagaaagatattgcagagaagatacaaaaacagggaggtgattatttattcgctgtaaaaggaaaccaggggcggctaaataaagccttcgaggaaaaatttccgctgaaagaattaaataatcccaagcatgacagttacgcaattagtgaaaagagtcacggcagagaagaaacccgtcttcatattgtttgcgatgtccctgatgagcttattgatttcacgtttgaatagaaagggcagctatggttagaaactacctgacgtcagtccttgcggggagcaggctttcgtaaatttgtcctgctacaacaggattaacttcacaaatatcatttctcaacgtctacacttactcctgtaaaccgctcaggagcagtaatgaatctacaacgatttgatgacagcaccctaatccgtatctttgcccttcatgagttacatcgactgaaagaacatggcttaacgcgcggggcgcttctcgattatcacagccgctataaactcgtctttctggcgcattctcagccggagtaccgcaaacttggcccgttcgtggctgatattcaccagtggcaaaatctggatgactattacaaccagtaccgccaacgcgtagttgttttgctttctcaccccgccaacccgcgcgatcacaccaatgttttgatgcacgttcagggttattttcgcccgcatattgattccacagaacgccagcagctggctgcgcttatcgacagttatcgccgtggcgagcaaccacttcttgcgccgctgatgcgtatcaaacactatatggcgctttatcctgacgcctggctttcagggcagcgttatttcgaactttggccgcgtgtgattaacttgcgccattcaggagttttatgactacccatctggtctggtttcgccaggatttacgtctgcacgataatctcgcactggctgccgcctgccgcaattcgtctgcacgcgtgctggcgttgtatatcgctacaccacgccagtgggcgacgcataacatgtcgccgcgtcaggctgaacttatcaatgctcaactgaatgggctacaaatagcgcttgcggaaaaaggtattcctttattgttccgtgaagtggatgactttgtcgccagtgtcgaaatagttaaacaggtgtgcgcggaaaacagcgttacccacctgttttataactatcagtatgaagtgaatgagcgggcgcgggatgtggaagttgaaagagcgctgcgtaacgtggtgtgtgaaggatttgatgacagcgtgatcctgccgcctggcgcggtgatgaccggtaatcacgagatgtacaaagtctttacgccttttaagaatgcctggctgaaacggctgcgggaagggatgccggagtgcgtcgctgcgccaaaagttcgtagtagcggatcgatagagccctcgccatccattacgctgaattatcctcgtcagtctttcgatactgcgcattttccggtggaagaaaaagcggcgattgcgcaattacgccagttttgccagaacggtgccggagaatatgagcaacaacgagattttccggcagtggaaggcaccagccgtttgtcggccagcctggcaacgggcgggttatcgcctcgccagtgcttgcatcgcttgttggctgaacagccgcaggcgctggacggtggggccggtagtgtctggcttaatgagctgatctggcgcgagttttaccgtcacctgataacgtatcacccctcgttgtgtaaacatcgtccatttattgcctggacggatcgtgtacagtggcagagcaatcccgcacatttacaggcctggcaggaaggcaaaacgggatacccgattgttgatgccgctatgcgtcagcttaacagcactggctggatgcataacaggctacggatgattacagccagttttctggtgaaagatttattgatcgactggcgcgaaggcgagcgatatttcatgtcgcagctgattgatggtgatttggcagccaataacggtggctggcagtgggccgcttcaaccggaaccgatgcagcgccgtattttcgtattttcaacccgacaacccagggcgagaaatttgatcatgagggcgagtttatccgccagtggctaccggaactgcgcgatgtgccagggaaagtggtgcatgagccgtggaagtgggcgcagaaagcaggtgtgacgctggattatccgcaaccgatagtcgagcacaaagaagcgagagtacaaacgttggcagcgtatgaggcggcgcggaaggggaaataacagacgcgtcaggcaatcgagcccagatgccggatgcggcgtgaacgccttatccagcctacaaatttgtgcaaattcaataaattgcaggaaatacgtaggcctgataagacgcgtcaagcgtcgcatcaggcatcggtgctggcctattaagactccagcgccagcgcgcggtttctgaatttcagcgcctgatacagccaaatcatcagtaccagtcctacacacgccagtgcgccccaggtaatttgatcaaatacttcaatatatgcattgatggagtagttgatcgccccggaagcatcaaacgaagcctgcgatgtctgatcggcaatcacgcccgccagatagttcgcgatcgcgccagaaagcagcatgtagatgccggttaatacgccggtcacaccggggatttcaatgcgcgtaatttgcgacatggcaaccgggtcgataaacagttccgcaaagcccatcaccgccaggcctaataccatcagtggcagagaagagtgaccatacattgcggaccagcgggcgcttaaggtcagaatgcagaatccggcgctcatcaggccaaggccaagagcaaatttcccccagatgcgcacggtacgattacccgcgacactctcttttaccacccacgccaggaacacaccgcacagcataactgcgaaggcattaatcgactggaacatcgcggtcggaacggtataaccaaacatatcgcggttaacgaagcggtcgatataaaggctaatcgagctaccgccctgttgtgcgaaggcccagaacaacatactgaagaaggtgagcgtcacaatcagccccagctccttccgctgtttctggttttctgctttgcgataaatttttgccagtacacccaggccaataatagtcgcgacaattaaggcgtataccgaccactctttccagaacagtatggtaatcagtgcaggcgttgccaccagcagaaccagcagccatccccagttcggcaggagaaagtttgtcgcacgcagtacttttttgttaacgccgcgggtatgagtgaaatgacgattgccacataagaaaatgaccagacccgcgatcatgccaaccgccgccaggccaaagcccatcgcccagctgtactcttcctgggcgtaaccacaggcgataggtgcgataatagaccccacgttacccgccgcatacatcagcgagaaaccgccatcacgacgcggatcggttggctcatacagctcgccgagcagacagcttacgttagatttaaacaggccatagccgcagacgataatcgccagggacagatagaggaatgacggatggatctcactggcacccagcaccacatgaccgatcgccatcaacaacgcccccagcatcaccgccatgcgattgccgagaactttatccgccaaaaagccaccgaggattggcgtgacatacaccagcgaacagtaggcgctaaataactcgtaggcgtgagtatcgttgtattttagttgattggtgagatagagaatcagcagggcacgcatgccgtaaaagctaaaatattcccagatttgcagcgcaacgacatagtaaatagcgcgcggctgtgatgcgtgtttattcataataattccacaattgacggcaacgtcacgtaatagttgcgcggcgtgcttgtgtttccttaaagttaaaactttgatacagatctgattatttatgcaatatgctgtctgattgcataaatatacattagctgaagcgtgatgatataaacaatttgcgtcttttggcgtcgggtttgtttcttaatatgtcaaaagattggctatcgacgaactggcgaggtaacgctatgttaacggtgtagctatcagaatacggaaggcgcgaagatgaaaaacaccgaactggaacaactgattaacgaaaaactgaacagcgcggcgattagtgattacgcgccgaatggtttgcaggtggaaggcaaagagacggtgcaaaaaattgttaccggtgtcaccgccagccaggctttgctcgatgaggcagtgcgtctgggcgcggatgcggtcattgtgcatcatggctacttctggaaaggagagtctccggtcattcgcggaatgaagcgtaaccgtttaaaaacgttgctggcgaatgatatcaacctgtatggctggcatttgccgcttgacgcacatcctgagctgggcaataacgcacagctggcggcgttactggggatcacggtcatgggcgaaattgagccgttggtgccgtggggcgaactgaccatgcctgtgccgggactggagctggcttcctggattgaagcgcgtctgggacgtaagccgttatggtgtggcgataccggacctgaggtggtccagcgcgtcgcctggtgcacgggcggcgggcaaagttttatcgatagcgccgcgcgttttggcgtggatgcttttattactggcgaagtttctgaacagaccattcattcagcccgcgagcagggattgcatttttatgctgcaggtcaccatgccactgaacgtggtggtattcgcgcattgagcgagtggctgaatgaaaataccgatcttgatgtgacctttattgatattcctaatcctgcataacgaataatcagagggatcgaaagtgcaacgagcgcgttgttatctgataggtgaaacggcggtagtgctggaactggaaccgccggtgacgctggctagccagaaacggatctggcgactggcgcagcgtctggtggatatgccgaatgtggttgaagccattcccggcatgaacaatatcacggtgattttgcgtaatcctgagtcgctggcgctggatgccatagagcgtttgcaacgctggtgggaggagagcgaggcgctggagccggagtctcgctttattgaaattccggtggtttacggtggtgcaggcggaccggatttggcggtggtcgcggcgcattgcgggttgagcgaaaaacaggttgttgaattgcactcctccgtggaatacgtggtctggtttttaggttttcaaccgggcttcccgtatctcgggagtttgccggaacaactacacacgccacggcgcgctgaaccgcgcttactcgttccggcaggttctgtcgggatcggcgggccgcagactggtgtttatccgctggcaacgccgggtggctggcagttgattggtcatacctcactcagcctgtttgatccggcgcgtgacgaacccatcttattacgtccgggagacagcgtgcgctttgtaccgcagaaggagggagtatgctgaagattattcgtgcgggcatgtataccactgtgcaggatggcggtcgtcacggttttcgccagtcgggtatcagccactgcggcgcactggatatgcccgcgttacgcattgctaacctactggtgggtaatgacgccaatgcccccgcgctggagatcacgctcggtcagttaactgttgagttcgaaactgatgggtggtttgctctgacgggtgccggttgcgaagcgcggctggatgataatgccgtctggaccggctggcgattgccgatgaaagcaggccagcgtttaacgcttaaacgcccgcagcacgggatgcgcagttatctggcggtcgcgggtggtattgatgttccgccggtaatgggctcatgcagcaccgatctcaaagtggggattggcgggctggaaggccgtttactgaaggatggtgaccgactcccgattggcaaatcgaagcgtgattctatggaagcgcagggcgttaaacagctgctgtggggcaaccgcattcgcgccttgccggggccggaatatcatgagttcgatcgcgcctcgcaggatgcattctggcgttcgccctggcagcttagctcgcaaagtaaccgcatgggctatcgcttacaggggcaaattttaaaacgcaccaccgatcgcgaactgttatctcacggtttgttaccgggcgtggtgcaggtgccacataacgggcagccgattgtgttgatgaacgacgcacagaccaccggtggttacccgcgtattgcctgtatcattgaggctgatatgtaccatctggcgcaaattccgctcggtcagccgattcattttgtccagtgttcactggaagaggcactaaaagcacggcaagatcagcaacgttattttgaacaattagcgtggcggctgcacaatgaaaattgacctgaacgccgatctgggcgaaggctgcgccagcgacgcagagctattaacgctggtttcctctgccaatattgcctgtggatttcatgcaggcgatgcgcaaatcatgcaggcttgcgtgcgtgaagcaataaaaaatggtgtcgcgattggcgctcacccgagttttcccgacagggaaaattttggtcgcagcgccatgcagctgccgccagaaaccgtttacgcccagacgctgtatcaaattggcgcgctggcaacgattgcccgtgcgcaaggcggcgtaatgcgtcatgtcaaaccgcacggcatgttgtacaaccaggcggcgaaagaagcacaactggcagacgccatcgccagagcggtatacgcttgcgatccagcattgattctcgtcgggctggcgggaagcgagctgattcgtgcaggcaagcaatatggtctgacaacgcgcgaggaagtgtttgccgatcgcggttatcaggctgacggctcgctggtgccgcgaagccagtcaggcgcgttgattgaaaacgaagaacaggcgctggcgcaaacgctggagatggtgcaacacggcagagtcaaaagtatcaccggcgaatgggcaacggtcgcggcgcaaacggtctgcctgcatggcgacggcgagcacgcactggcgttcgcccgccgactacgctctgcatttgccgaaaaggggattgttgtcgcagcataaccccgattaataaagaatgaaaaaaggatatcaccatgcctgaaggcccggagatccgccgtgcagcggataacctggaggcggcgatcaaaggcaaaccactaactgatgtctggtttgccttcccgcagttaaaaccttatcaatcacaacttatcggtcaacacgttacccatgtggaaacgcgtggtaaggcgttgttaactcatttttccaacgacttaacgctctacagccataatcagctttacggcgtctggcgcgtggttgataccggcgaagagccgcagaccacgcgagtattgcgggtaaaactgcaaacggctgacaaaaccattctgctttatagcgcctcggatattgagatgttgaccccggaacaactgaccacgcatccgtttttacaacgcgttggtcccgatgtgctggatccgaatctgacgccggaggtggtgaaagaacgattattgtcgccgcgctttcgtaaccgtcagtttgctggattactgctcgatcaggcgtttctggctgggcttggcaattatttgcgggtggagatcctctggcaggttgggttgactggaaatcataaagcgaaagatctcaatgcggcgcaactggatgcactcgcacacgcgttactggagattcctcgattttcctacgctacgcgggggcaggtggatgagaataagcatcatggggcgctgtttcgctttaaggtttttcatcgagatggcgaaccgtgcgaacgttgtggcagcatcattgagaaaaccacgctgtcatctcgcccgttttactggtgccctggctgccagcactaggccgaccgcttcggcgcataggttgaaataaaccgcgcaatggcaggccctgtcagcaaaatactgaacaggcgtagggtttgcatcgccataatgagcgccatatcggcattgctccctgcggcgatgaccgccacggtatcaagcccgccggggctggtggcgaggtaggcagtcataaaatcaatgtgcataaaccgggtcagcccccacgccatacccgcacaaatagccagcagagcaaaaatcgacagcaggatttgcggtagcgggcgtagtgcccgcagtaagatttgtttatcgaaaccaagaccaatccgccagccaattgccatatacgccatcgccagcagccattccggtagttcgatggtgatgagctgaccagactggagcactgcgcccgccagcatcgggatgagcatcgtgccggaaggaagacgcagcaggcatcccactgtaccggcaacgaccgcgagcaaaatagtaagcaggagattaatgctcactggcgggaaccagacgatatgctggttaaccgcttcagcgttatcgcccagcatcatgcgggtgaccagaacagcggcccccgcgacgaacagcactcgcagatattgcataaacgccaccaggcgaatatctgcgccgtaatcttgcgccatagcgaccattgccgccgcgccgccaggagaggagccccaggcaccggtatttccaggcaatgagctatagcgcaccaataaccaacccacaatggcgctggaaagcagcgttaccagtaaaattgcaagcacgatcggccagttgacggccagggtggtgagaatcgaaccagtgaggttttgcgcaatcatgcagccaagaatggcctgggcggcgagaaaagcagagcggggaagttgcagagtaattccgcgcatactaaagatgatcccggcgatcatcggcccaagtaatagcgccgccgggagatgtaccgcgaggaaaccaatagaaaggagaagtgatagcacacataacattccccactgcaaaactggcatccttcgctccctcattattttctctttggtgtatcgatacagcataaagaaagctgggccaggaaaaaataacagcaatcaaggaaaaggggaaaatcagcaattttctgaaagagatgccctttccggcggcaaagggcatcatggtaaatcagttatagttaatcttaaaaagcaccactgtatcgaaggggccagcctcgatgggggtgcctggaatggacgaaagttcagccgtataggttttttcgtagaccaacatgtcactggtgaaatcggcgtattcagcatatttattgaaggtataaggcgaggcgttttcatccagtaaacgtagcttcagaccattaccaatcaacaatgctttatcttcttcaaccaacgtttcttcggtataaaaggaggaactgactttaaatccgtcggtgcattgatcgttttggctcttggtcgttttaatactgaacgttttcgacattgtgtggcgacgtatatccagcaaattaaatttaccaaaatcaatcacctgtgtttccggtgaaatggaaaaattgacgctgcaatccagcacgcgaatgttttccagaccagtaatatgatatttcaggttttgggcagtagggtcttcgttaacgctaccggcaccgtcaaattgcacgacgatatagtcgctaagcgtactttgataatcatgcggcggcatttctcgtattttgacgtataaccgcatgcgagcgagaaaggtacgcgacatatgaatattagcgggatcgcccgagcaaattttgttctgccatcccatcgcgatgatctgctcaggggtataaatatcaatgttcttactgtcgatacactggttagtgtcgatgcgactttttcccagactggcatcgtaatcgacaccgttgtatgtcacgccgagttgataataacgatcctgcacccccggataggggtttacccaggcgtagacatgctcgctttcaaagttgccgttggtattgttgtcacaatagacgggaattttaatatcgtcagattcccagatcttatcaccgggtttggcattgcctggtacagcaaacggttgaatcgcttctgatttttctactgcgccaccagatgtaccaaaatagcagttcagcgccattgcagacttcaacggcagaaataacaggcagatgacgagcaacaatcccttgccagcactcatttcgcctccactgcttgtaaacggcattgtccgctgcagttgagcgtcgtcatgcgtaatgcgccgtaatcatccatgtaaccgagataaaactggctgccgctataacttccggtgtttgtgttgaccgtactaaaaggtgcaaccatcacggttttgaagcctgggagaacgcctttttcatttctccccagataggcaatggtcagataatacgcggtaggatttttcagtgtcagttggttgccctgctggctgacctgtaactgcagttcgaccttttctcctgctttcttgcgtaatgcagccggtcgccagaacaatttaatacgactttgaatagcgacctgaagtatcgcatggtcgctgcttttatccggagcgggaggaatttcgcgcatattgtagaaaaatagcgtttcgcgatcgccaggtaattgtgtggttgaggcttgtttcacaacccgcacctgcgatgtcgctttcggttccagacgttgaatagggggcaaagcgaccagaagagcatcgcttttctcccctttttcattttctatccaggaataagcaagataaggcagtttgtcactttggttttcgatacgcaggctggtggctttgtcattggcgttaaacacaatgcgtgtgcgatcgggttgcaccgcagcattgcaacccaagctgatggttaacaacattaagggtaatcctttaataaatgtcattctcttttccttaattaatgacaaggtaaaatcaggcgtttggtcgtgtcttccagacgttctggcagatgaataatgcagctttgctcaccccagaccacggtaaacagttgattttcagcgacaccgcttaaccaggcatgtccttcctcgccaaccatacccacgctaatgccgctgtcatcctggcggatatccgcaccgaggggagggaactgaccgctggcgttgcgtatgatgacgttaacgtctttaccggaacgggaagccagtgatttgtaacctatcgcgccttcaatccatgtttccttgatgacgttttctgcaactgttacgccgtcgggtaagtcattcatgttcaccgccacggtggaaggctggtaactggaaatcaacggcaccaccgcaatgccaaaatggttggtgtagtcgagattgccctgaaccggaatatctgccacgccatcggtgctgaccatcaggcgtggttcattggtggagctgcggcgatgaaatgctgcaccatattgggttgcggtgaaagaaccgctccagctgctgctgacggaactgtaatcactggcggcataggtaccagaaatatcccactcacccgctgaactcaggtgctgatagttaccgctcacctgggctccattgtccggacgatcggattgcagtccggcagacatgccccagctattacgttcatccagcgtatcgttccacgacatgcggtgtatggtgctgtggctactgttttgcatgtcatagccaacccgaccaccgttaccgaaggggagcgaaatcgacagataaatctggttgtcgcgatctttatcttcgtagtgggtcgtattgaatgacgtcgaaatcgagatatctctccagtcaccaatatcaacattaaaacctgctgtgatgttggcggtcgtggaggcgtctgcattccaccaggtttgatgtagcaggttggcgtaaagattgaggtttagtggggtaatcggttggcccacggataagctgatcgtctgtttttcgtcctgcgcatcgctgtcgttgtatttgtgatccagatagttggcgtagctgtgaaaatgacgatctgagaagcgataagcggcgagcgaaatcgtgctgttggtggcatccacttgtttgctgtaattaaaacggtagcttaagccccgctcgtcctgctgagtatcaaaatggctactggcccaggtgacatcaaaggacagtgcgccaagccacagcatattttgcccgatacccattgcggcagaatggtagtcatcatcagaaatcagcaggccgccgtacagcgaggtgtttgagagcatcccccaggaaacttcattgctaaaaaaggtttcattttcagtttgatgtgacatggaaggccgtggctgacccgcggccaatttatagcgaacctgtccctggcgagtcaggaagggcgtcgatgctgccgaaacctggaaattgttcacccgaccatcttcttccgtcactttgacatccagcgtgccctgaacagactgattgaggtcatcaataataaacgggcctggcgggacttttttctggtaaatgacgcggcctgattgactgatcgtcaccgtggcattggtctgtgcaataccgctaatttgtggggcgtagccacgcagctcccacggtaacattcgatcgtcactcgccagtgccgcgccggtataagaaaaaccatcgaaaatattggaactgaaatcggtttcgccgagggttaacttagagcctaattgcggtaatggacgaaaaagataggtgcgcgatattccgcctgactggtcatggttatcttcgctatcggtcttattaagctggtaatcactgcgtaagcgccatgccccggcgttaattccggcggtaccgtaggcattcaggttagtgctgctgctgccgtcctgtgggcggtagctgctggcaaacaagttgtaatccatcaggacaccggcaacaccttctttccatgtagaggggggagcccagttttctgagtgccacgccagccaggcttgcggaatactaatattcagttgctgattggcttgatcgaaattgaagagcatttcaggtcgggaactgaaatcaatacaccgatctatctgtggcaaggactgacggatatctggttttaaaccaaatttatcgaccagtgaatcattgatgcatggaatggttttgtcaccctttttttgccagttaattttttgcccattactgattttgttgttattcaccgcaacgctaacaaaatattcaccgggagcaatgactcctttttcctttaataatgaaatatcaatgcggtcgcgcattgatttatcgagaacattcagattgaattcgaccgccattgcgcaaggcatcgccatgaccaggcaggatacaaaagagagtcgataaatattcacggtgtccatacctgataaatattttatgaaaggcggcgatgatgccgccaaaataatacttatttataatccagcacgtaggttgcgttagcggttacttcacctgccgtgacatcgactgcattatcaatttgttccatccaggcgaaaaagttcagcgtctgttctgatgagcttgcatccaggtcaagatctggcgcggctgaacctaatacgatgttaccgtcatttttgtccatcagtcgtacaccgaccccagttgcttcgcctgcactggtgttgctcaacaaaggcgtagcaccagttgtcttagccgtgctatcgaaggttacgccaactttggataccggcattccgctaccgttgtcagaagcaggcagatcacagttgatcaagcgaatgtcgacggccactttattgctatgatgctcccggtttatatgggttgtcgtgacttgtccaagatctatgtttttatcaatatcttctggatgaatttcacaaggtgcttcaataacctcccccttaaagtgaatttcgccagaaccttcatcagcagcataaacaggtgcagtgaacagcagagatacggccagtgcggccaatgttttttgtcctttaaacataacagagtcctttaaggatatagaataggggtatagctacgccagaatatcgtatttgattattgctagtttttagttttgcttaaaaatattgttagttttattaaatgcaaaactaaattattggtatcatgaatttgttgtatgatgaataaaatataggggggtatagatagacgtcattttcatagggttataaatgcgactaccatgaagtttttaattgaaagtattgggttgctgataatttgagctgttctattctttttaaatatctatataggtctgttaatggattttatttttacaattttttgtgtttaggcatataaaaatcaacccgccatatgaacggcgggttaaaatatttacaacttagcaatcaaccattaacgcttgatatcgcttttaaagtcgcgtttttcatatcctgtatacagctgacgcggacgggcaatcttcataccgtcactgtgcatttcgctccagtgggcgatccagccaacggtacgtgccattgcgaaaatgacggtgaacatggaagacggaatacccatcgctttcaggatgataccagagtagaaatcgacgttcgggtacagtttcttctcgataaagtacgggtcgttcagcgcgatgttttccagctccatagccacttccagcaggtcatccttcgtgcccagctctttcagcacttcatggcaggtttcacgcattacggtggcgcgcgggtcgtaatttttgtacacgcggtgaccgaagcccatcaggcggaaagaatcatttttgtctttcgcacgacgaacaaattccggaatgtgtttaacggagctgatttcttccagcattttcagcgccgcttcgttagcaccgccgtgcgcaggtccccacagtgaagcaatacctgctgcgatacaggcaaacgggttcgcacccgaagagccagcggtacgcacggtggaggtagaggcgttctgttcatggtcagcgtgcaggatcagaatacggtccatagcacgttccagaatcggattaacttcatacggttcgcacggcgtggagaacatcatattcaggaagttaccggcgtaggagagatcgttgcgcgggtaaacaaatggctgaccaatggaatacttgtaacacatcgcggccatggtcggcattttcgacagcaggcggaacgcggcaatttcacggtgacgaggattgttaacatccagcgagtcgtgatagaacgccgccagcgcgccggtaataccacacatgactgccattggatgcgagtcgcgacggaaagcatggaacagacgggtaatctgctcgtggatcatggtatgacgggtcaccgtagttttaaattcgtcatactgttcctgagtcggtttttcaccattcagcaggatgtaacaaacttccaggtagttagaatcggtcgccagctgatcgatcgggaaaccgcggtgcagcaaaataccttcatcaccatcaataaaagtaattttagattcgcaggatgcggttgaagtgaagcctgggtcaaaggtgaacacaccttttgaaccgagagtacggatatcaataacatcttgacccagcgtgcctttcagcacatccagttcaacagctgtatccccgttgagggtgagttttgcttttgtatcagccatttaaggtctccttagcgccttattgcgtaagactgccggaacttaaatttgccttcgcacatcaacctggctttacccgttttttatttggctcgccgctctgtgaaagaggggaaaacctgggtacagagctctgggcgcttgcaggtaaaggatccattgatgacgaataaatggcgaatcaagtacttagcaatccgaattattaaacttgtctaccactaataactgtcccgaatgaattggtcaatacttccacactgttacataagttaatcttaggtgaaataccgacttcataacttttacgcattatatgcttttcctggtaatgtttgtaacaactttgttgaatgattgtcaaattagatgattaaaaattaaataaatgttgttatcgtgacctggatcactgttcaggataaaacccgacaaactatatgtaggttaattgtaatgattttgtgaacagcctatactgccgccaggtctccggaacaccctgcaatcccgagccacccagcgttgtaacgtgtcgttttcgcatctggaagcagtgttttgcatgacgcgcagttatagaaaggacgctgtctgacccgcaagcagaccggaggaaggaaatcccgacgtctccaggtaacagaaagttaacctctgtgcccgtagtccccagggaataataagaacagcatgtgggcgttattcatgataagaaatgtgaaaaaacaaagacctgttaatctggacctacagaccatccggttccccatcacggcgatagcgtccattctccatcgcgtttccggtgtgatcacctttgttgcagtgggcatcctgctgtggcttctgggtaccagcctctcttcccctgaaggtttcgagcaagcttccgcgattatgggcagcttcttcgtcaaatttatcatgtggggcatccttaccgctctggcgtatcacgtcgtcgtaggtattcgccacatgatgatggattttggctatctggaagaaacattcgaagcgggtaaacgctccgccaaaatctcctttgttattactgtcgtgctttcacttctcgcaggagtcctcgtatggtaagcaacgcctccgcattaggacgcaatggcgtacatgatttcatcctcgttcgcgctaccgctatcgtcctgacgctctacatcatttatatggtcggttttttcgctaccagtggcgagctgacatatgaagtctggatcggtttcttcgcctctgcgttcaccaaagtgttcaccctgctggcgctgttttctatcttgatccatgcctggatcggcatgtggcaggtgttgaccgactacgttaaaccgctggctttgcgcctgatgctgcaactggtgattgtcgttgcactggtggtttacgtgatttatggattcgttgtggtgtggggtgtgtgatgaaattgccagtcagagaatttgatgcagttgtgattggtgccggtggcgcaggtatgcgcgcggcgctgcaaatttcccagagcggccagacctgtgcgctgctctctaaagtcttcccgacccgttcccataccgtttctgcgcaaggcggcattaccgttgcgctgggtaatacccatgaagataactgggaatggcatatgtacgacaccgtgaaagggtcggactatatcggtgaccaggacgcgattgaatatatgtgtaaaaccgggccggaagcgattctggaactcgaacacatgggcctgccgttctcgcgtctcgatgatggtcgtatctatcaacgtccgtttggcggtcagtcgaaaaacttcggcggcgagcaggcggcacgcactgcggcagcagctgaccgtaccggtcacgcactgttgcacacgctttatcagcagaacctgaaaaaccacaccaccattttctccgagtggtatgcgctggatctggtgaaaaaccaggatggcgcggtggtgggttgtaccgcactgtgcatcgaaaccggtgaagtggtttatttcaaagcccgcgctaccgtgctggcgactggcggagcagggcgtatttatcagtccaccaccaacgcccacattaacaccggcgacggtgtcggcatggctatccgtgccggcgtaccggtgcaggatatggaaatgtggcagttccacccgaccggcattgccggtgcgggcgtactggtcaccgaaggttgccgtggtgaaggcggttatctgctgaacaaacatggcgaacgttttatggagcgttatgcgccgaacgccaaagacctggcgggccgtgacgtggttgcgcgttccatcatgatcgaaatccgtgaaggtcgcggctgtgatggtccgtgggggccacacgcgaaactgaaactcgatcacctgggtaaagaagttctcgaatcccgtctgccgggtatcctggagctttcccgtaccttcgctcacgtcgatccggtgaaagagccgattccggttatcccaacctgtcactacatgatgggcggtattccgaccaaagttaccggtcaggcactgactgtgaatgagaaaggcgaagatgtggttgttccgggactgtttgccgttggtgaaatcgcttgtgtatcggtacacggcgctaaccgtctgggcggcaactcgctgctggacctggtggtctttggtcgcgcggcaggtctgcatctgcaagagtctatcgccgagcagggcgcactgcgcgatgccagcgagtctgatgttgaagcgtctctggatcgcctgaaccgctggaacaataatcgtaacggtgaagatccggtggcgatccgtaaagcgctgcaagaatgtatgcagcataacttctcggtcttccgtgaaggtgatgcgatggcgaaagggcttgagcagttgaaagtgatccgcgagcgtctgaaaaatgcccgtctggatgacacttccagcgagttcaacacccagcgcgttgagtgcctggaactggataacctgatggaaacggcgtatgcaacggctgtttctgccaacttccgtaccgaaagccgtggcgcgcatagccgcttcgacttcccggatcgtgatgatgaaaactggctgtgccactccctgtatctgccagagtcggaatccatgacgcgccgaagcgtcaacatggaaccgaaactgcgcccggcattcccgccgaagattcgtacttactaatgcggagacaggaaaatgagactcgagttttcaatttatcgctataacccggatgttgatgatgctccgcgtatgcaggattacaccctggaagcggatgaaggtcgcgacatgatgctgctggatgcgcttatccagctaaaagagaaagatcccagcctgtcgttccgccgctcctgccgtgaaggtgtgtgcggttccgacggtctgaacatgaacggcaagaatggtctggcctgtattaccccgatttcggcactcaaccagccgggcaagaagattgtgattcgcccgctgccaggtttaccggtgatccgcgatttggtggtagacatgggacaattctatgcgcaatatgagaaaattaagccttacctgttgaataatggacaaaatccgccagctcgcgagcatttacagatgccagagcagcgcgaaaaactcgacgggctgtatgaatgtattctctgcgcatgttgttcaacctcttgtccgtctttctggtggaatcccgataagtttatcggcccggcaggcttgttagcggcatatcgtttcctgattgatagccgtgataccgagactgacagccgcctcgacggtttgagtgatgcattcagcgtattccgctgtcacagcatcatgaactgcgtcagtgtatgtccgaaggggctgaacccgacgcgcgccatcggccatatcaagtcgatgttgttgcaacgtaatgcgtaaaccgtaggcctgataagacgcgcaagcgtcgcatcaggcaaccagtgccggatgcggcgtgaacgccttatccggcctacaagtcattacccgtaggcctgataagcgcagcgcatcaggcgtaacaaagaaatgcaggaaatctttaaaaactgcccctgacactaagacagtttttaaaggttccttcgcgagccactacgtagacaagagctcgcaagtgaaccccggcacgcacatcactgtgcgtggtagtatccacggcgaagtaagcataaaaaagatgcttaagggatcacgatgcagaacagcgctttgaaagcctggttggactcttcttacctctctggcgcaaaccagagctggatagaacagctctatgaagacttcttaaccgatcctgactcggttgacgctaactggcgttcgacgttccagcagttacctggtacgggagtcaaaccggatcaattccactctcaaacgcgtgaatatttccgccgcctggcgaaagacgcttcacgttactcttcaacgatctccgaccctgacaccaatgtgaagcaggttaaagtcctgcagctcattaacgcataccgcttccgtggtcaccagcatgcgaatctcgatccgctgggactgtggcagcaagataaagtggccgatctggatccgtctttccacgatctgaccgaagcagacttccaggagaccttcaacgtcggttcatttgccagcggcaaagaaaccatgaaactcggcgagctgctggaagccctcaagcaaacctactgcggcccgattggtgccgagtatatgcacattaccagcaccgaagaaaaacgctggatccaacagcgtatcgagtctggtcgcgcgactttcaatagcgaagagaaaaaacgcttcttaagcgaactgaccgccgctgaaggtcttgaacgttacctcggcgcaaaattccctggcgcaaaacgcttctcgctggaaggcggtgacgcgttaatcccgatgcttaaagagatgatccgccacgctggcaacagcggcacccgcgaagtggttctcgggatggcgcaccgtggtcgtctgaacgtgctggtgaacgtgctgggtaaaaaaccgcaagacttgttcgacgagttcgccggtaaacataaagaacacctcggcacgggtgacgtgaaataccacatgggcttctcgtctgacttccagaccgatggcggcctggtgcacctggcgctggcgtttaacccgtctcaccttgagattgtaagcccggtagttatcggttctgttcgtgcccgtctggacagacttgatgagccgagcagcaacaaagtgctgccaatcaccatccacggtgacgccgcagtgaccgggcagggcgtggttcaggaaaccctgaacatgtcgaaagcgcgtggttatgaagttggcggtacggtacgtatcgttatcaacaaccaggttggtttcaccacctctaatccgctggatgcccgttctacgccgtactgtactgatatcggtaagatggttcaggccccgattttccacgttaacgcggacgatccggaagccgttgcctttgtgacccgtctggcgctcgatttccgtaacacctttaaacgtgatgtcttcatcgacctggtgtgctaccgccgtcacggccacaacgaagccgacgagccgagcgcaacccagccgctgatgtatcagaaaatcaaaaaacatccgacaccgcgcaaaatctacgctgacaagctggagcaggaaaaagtggcgacgctggaagatgccaccgagatggttaacctgtaccgcgatgcgctggatgctggcgattgcgtagtggcagagtggcgtccgatgaacatgcactctttcacctggtcgccgtacctcaaccacgaatgggacgaagagtacccgaacaaagttgagatgaagcgcctgcaggagctggcgaaacgcatcagcacggtgccggaagcagttgaaatgcagtctcgcgttgccaagatttatggcgatcgccaggcgatggctgccggtgagaaactgttcgactggggcggtgcggaaaacctcgcttacgccacgctggttgatgaaggcattccggttcgcctgtcgggtgaagactccggtcgcggtaccttcttccaccgccacgcggtgatccacaaccagtctaacggttccacttacacgccgctgcaacatatccataacgggcagggcgcgttccgtgtctgggactccgtactgtctgaagaagcagtgctggcgtttgaatatggttatgccaccgcagaaccacgcactctgaccatctgggaagcgcagttcggtgacttcgccaacggtgcgcaggtggttatcgaccagttcatctcctctggcgaacagaaatggggccggatgtgtggtctggtgatgttgctgccgcacggttacgaagggcaggggccggagcactcctccgcgcgtctggaacgttatctgcaactttgtgctgagcaaaacatgcaggtttgcgtaccgtctaccccggcacaggtttaccacatgctgcgtcgtcaggcgctgcgcgggatgcgtcgtccgctggtcgtgatgtcgccgaaatccctgctgcgtcatccgctggcggtttccagcctcgaagaactggcgaacggcaccttcctgccagccatcggtgaaatcgacgagcttgatccgaagggcgtgaagcgcgtagtgatgtgttctggtaaggtttattacgacctgctggaacagcgtcgtaagaacaatcaacacgatgtcgccattgtgcgtatcgagcaactctacccgttcccgcataaagcgatgcaggaagtgttgcagcagtttgctcacgtcaaggattttgtctggtgccaggaagagccgctcaaccagggcgcatggtactgcagccagcatcatttccgtgaagtgattccgtttggggcttctctgcgttatgcaggccgcccggcctccgcctctccggcggtagggtatatgtccgttcaccagaaacagcaacaagatctggttaatgacgcgctgaacgtcgaataaataaaggatacacaatgagtagcgtagatattctggtccctgacctgcctgaatccgtagccgatgccaccgtcgcaacctggcataaaaaacccggcgacgcagtcgtacgtgatgaagtgctggtagaaatcgaaactgacaaagtggtactggaagtaccggcatcagcagacggcattctggatgcggttctggaagatgaaggtacaacggtaacgtctcgtcagatccttggtcgcctgcgtgaaggcaacagcgccggtaaagaaaccagcgccaaatctgaagagaaagcgtccactccggcgcaacgccagcaggcgtctctggaagagcaaaacaacgatgcgttaagcccggcgatccgtcgcctgctggctgaacacaatctcgacgccagcgccattaaaggcaccggtgtgggtggtcgtctgactcgtgaagatgtggaaaaacatctggcgaaagccccggcgaaagagtctgctccggcagcggctgctccggcggcgcaaccggctctggctgcacgtagtgaaaaacgtgtcccgatgactcgcctgcgtaagcgtgtggcagagcgtctgctggaagcgaaaaactccaccgccatgctgaccacgttcaacgaagtcaacatgaagccgattatggatctgcgtaagcagtacggtgaagcgtttgaaaaacgccacggcatccgtctgggctttatgtccttctacgtgaaagcggtggttgaagccctgaaacgttacccggaagtgaacgcttctatcgacggcgatgacgtggtttaccacaactatttcgacgtcagcatggcggtttctacgccgcgcggcctggtgacgccggttctgcgtgatgtcgataccctcggcatggcagacatcgagaagaaaatcaaagagctggcagtcaaaggccgtgacggcaagctgaccgttgaagatctgaccggtggtaacttcaccatcaccaacggtggtgtgttcggttccctgatgtctacgccgatcatcaacccgccgcagagcgcaattctgggtatgcacgctatcaaagatcgtccgatggcggtgaatggtcaggttgagatcctgccgatgatgtacctggcgctgtcctacgatcaccgtctgatcgatggtcgcgaatccgtgggcttcctggtaacgatcaaagagttgctggaagatccgacgcgtctgctgctggacgtgtagtagtttaagtttcacctgcactgtagaccggataaggcattatcgccttctccggcaattgaagcctgatgcgacgctgacgcgtcttatcaggcctacgggaccaccaatgtaggtcggataaggcgcaagcgccgcatccgacaagcgatgcctgatgtgacgtttaacgtgtcttatcaggcctacgggtgaccgacaatgcccggaagcgatacgaaatattcggtctacggtttaaaagataacgattactgaaggatggacagaacacatgaacttacatgaatatcaggcaaaacaactttttgcccgctatggcttaccagcaccggtgggttatgcctgtactactccgcgcgaagcagaagaagccgcttcaaaaatcggtgccggtccgtgggtagtgaaatgtcaggttcacgctggtggccgcggtaaagcgggcggtgtgaaagttgtaaacagcaaagaagacatccgtgcttttgcagaaaactggctgggcaagcgtctggtaacgtatcaaacagatgccaatggccaaccggttaaccagattctggttgaagcagcgaccgatatcgctaaagagctgtatctcggtgccgttgttgaccgtagttcccgtcgtgtggtctttatggcctccaccgaaggcggcgtggaaatcgaaaaagtggcggaagaaactccgcacctgatccataaagttgcgcttgatccgctgactggcccgatgccgtatcagggacgcgagctggcgttcaaactgggtctggaaggtaaactggttcagcagttcaccaaaatcttcatgggcctggcgaccattttcctggagcgcgacctggcgttgatcgaaatcaacccgctggtcatcaccaaacagggcgatctgatttgcctcgacggcaaactgggcgctgacggcaacgcactgttccgccagcctgatctgcgcgaaatgcgtgaccagtcgcaggaagatccgcgtgaagcacaggctgcacagtgggaactgaactacgttgcgctggacggtaacatcggttgtatggttaacggcgcaggtctggcgatgggtacgatggacatcgttaaactgcacggcggcgaaccggctaacttccttgacgttggcggcggcgcaaccaaagaacgtgtaaccgaagcgttcaaaatcatcctctctgacgacaaagtgaaagccgttctggttaacatcttcggcggtatcgttcgttgcgacctgatcgctgacggtatcatcggcgcggtagcagaagtgggtgttaacgtaccggtcgtggtacgtctggaaggtaacaacgccgaactcggcgcgaagaaactggctgacagcggcctgaatattattgcagcaaaaggtctgacggatgcagctcagcaggttgttgccgcagtggaggggaaataatgtccattttaatcgataaaaacaccaaggttatctgccagggctttaccggtagccaggggactttccactcagaacaggccattgcatacggcactaaaatggttggcggcgtaaccccaggtaaaggcggcaccacccacctcggcctgccggtgttcaacaccgtgcgtgaagccgttgctgccactggcgctaccgcttctgttatctacgtaccagcaccgttctgcaaagactccattctggaagccatcgacgcaggcatcaaactgattatcaccatcactgaaggcatcccgacgctggatatgctgaccgtgaaagtgaagctggatgaagcaggcgttcgtatgatcggcccgaactgcccaggcgttatcactccgggtgaatgcaaaatcggtatccagcctggtcacattcacaaaccgggtaaagtgggtatcgtttcccgttccggtacactgacctatgaagcggttaaacagaccacggattacggtttcggtcagtcgacctgtgtcggtatcggcggtgacccgatcccgggctctaactttatcgacattctcgaaatgttcgaaaaagatccgcagaccgaagcgatcgtgatgatcggtgagatcggcggtagcgctgaagaagaagcagctgcgtacatcaaagagcacgttaccaagccagttgtgggttacatcgctggtgtgactgcgccgaaaggcaaacgtatgggccacgcgggtgccatcattgccggtgggaaagggactgcggatgagaaattcgctgctctggaagccgcaggcgtgaaaaccgttcgcagcctggcggatatcggtgaagcactgaaaactgttctgaaataaatatctgtaataagaaatagccctcgccgcttccctctacaggaatggcgaagggctgtcggtttcgacatggttggccatcgtatgatggccttttttgtgcttatcgcgatgattttcgctgcgctatcagggtaaatttatagtcatcggtattaaaagcgttgcggctatattcaaacacccgaccatcaactaaatatccacgcgatactttttcaagaatcggctttgtctggctgatattaagcagacggctcatctcttcggttggcatcagaggaatgatttcctgttcgctacgatcgataaccattttcttcacttcttcgataaagtgatatttcgaattttccatgacctgccaggtgagatccgggaacaacgcaagcggcatccaggtttcttccagcgccattggcttttgcttgcgatagcgcacgcgcttcacatgccacacacgatcctgcggggtgatttgtagctgttgctgaagaaaatcgtcagccggaatcacttcgaatatcagaacttcactgtgtgtatcgacgtgacggtccgacagtttttcatcaaaactggttaactgaaaaatatcgtaattgacccgctcttctttgacgtaagtcccgctgccctgaatgctttcgaggatctgctgctcgactagctggcgcaaagcctgacgcaccgtaacccggctgacgccaaactctgtttgtagcgctgattcagtgggtaacgcatcgccaggtttaagctcgccacgcgcaatttgttcacgaatgcgatcggcaatctgccggtataagggcttgtgtcccatttttagtatctcattaatacgaatttaaccattatgcccgataaattcatcctgtaaataatacaaatacaatacaaataatttcaatcaagtgaaattgatcacataatggtattgttttatcgggcacactggcgcgactataaaaacgatcaagtgaggatcatgatgaatctgacgactctgacccaccgcgatgcgttgtgtctgaatgcgcgctttaccagccgtgaagaggccatccacgcgttgactcaacgtcttgctgctctggggaaaatttccagtactgagcaatttctggaagaagtgtatcgccgtgaaagccttggcccgaccgccttaggtgaagggttggctgtgccgcatggcaaaactgctgcggtaaaagaagcggcgtttgcggtcgccacactcagcgagccgcttcagtgggaaggcgttgatggcccggaagcagttgatttagtggtgctgctggcgattccccccaatgaagcgggtactacgcatatgcaactgctgacagcgctgaccacgcgccttgcggatgatgagattcgggcgcgtatacagtcggcgacgacgcctgatgagttgctctcggcgctggatgacaagggaggcacgcaaccttctgcctctttttccaacgcgccaactatcgtctgcgtaacggcctgtccggcgggtattgctcacacctatatggctgcggaatatctggaaaaagccggacgcaaactcggcgtaaatgtttacgttgaaaaacaaggcgctaacggcattgaagggcgtttaacggcggatcaactcaatagtgcaaccgcctgtatttttgcggctgaagtcgccatcaaggagagtgagcgttttaatggcattcccgcgctttcagtgcctgttgccgagccgattcgccatgcagaagcgttgatccaacaagcgcttaccctcaagcgtagcgatgagacgcgtaccgtacagcaagatacgcaaccggtgaaaagtgtcaaaacggagctgaaacaggcactgttgagcggaatctcttttgccgtaccgttgattgtcgcggggggcacggtgctggcggtcgcggtattactgtcgcaaatcttcgggctacaagatctgtttaatgaagaaaactcctggctgtggatgtaccgcaagctgggcggcgggctgctcggaattttgatggtaccggtgctcgcggcctataccgcctattctctggcagataaaccggcgttagcgccaggctttgcggctggacttgccgccaacatgatcggctccgggtttctcggcgcggtcgttggcggattgatagccggttacttgatgcgctgggtgaaaaatcacttgcgtcttagcagtaaattcaatggattcctgactttttatctctacccggtgctcggtacgttgggagcgggcagtctgatgctgtttgtggtgggggaacctgtcgcctggatcaataactcgcttaccgcctggctgaacggtctgtcaggaagtaacgcgctgttgctgggtgccattctcggttttatgtgttcctttgaccttggagggccagtgaataaagccgcttatgcattctgcctgggcgcaatggcgaacggcgtttacggcccgtatgccattttcgcctccgtcaaaatggtttcggcatttaccgtaaccgcttccacgatgctcgcaccgcgcctgtttaaagagtttgaaattgagaccgggaaatccacctggctgttagggctggcaggtattaccgaaggggcgatcccgatggcgattgaagatccgctgcgggttattggttcgtttgtgctgggctctatggtaacgggcgctattgtcggtgcgatgaatatcggcctttcgacacccggtgccggcattttctcgctctttttacttcatgataatggcgcgggcggtgttatggcggcaattggctggtttggcgcggcattggtgggggctgcaatctcgactgcaattctcctgatgtggcggcgtcacgcggttaagcatggcaactatctgactgatggcgtaatgccataaacaaaaaggaaacgacgatgaaagcagtatctcgcgttcacatcaccccgcatatgcactgggatcgagagtggtatttcaccaccgaagagtcacgtattctgctggtcaataatatggaagagatcctgtgccgactggaacaggacaacgaatacaaatattacgtactcgacgggcaaacggcgatcctcgaagattatttcgcggtgaaaccggaaaacaaagaccgtgtgaagaaacaggtagaagccggcaagttgattatcggcccctggtatacccagaccgataccacgattgtttctgcggaatccatcgtccgtaatctgatgtacggaatgcgtgactgcctcgcgtttggcgagccgatgaaaataggttatttaccagattcctttggcatgtccgggcaactgccgcatatctacaatggatttggcattacccgcaccatgttctggcgcggatgttcggagcgccacggtactgataaaaccgagtttttgtggcaaagcagtgacggtagcgaagtgacggcgcaggtgctgccgctgggctacgccatcggtaagtacttacctgccgacgaaaacggattacgtaaacgcctcgacagttattttgacgtgctggaaaaagcgtctgtaaccaaagagattttgctgccgaatgggcatgaccagatgccattgcagcaaaatatcttcgaagtgatggataagctacgtgagatctaccctcaacgtaagtttgtgatgagccgctttgaagaggtatttgagaagatcgaagcgcagcgagataatctggcaaccctgaaaggggaatttattgatggcaaatatatgcgcgtgcatcgcaccatcggttctacgcgtatggatatcaaaattgcccacgcgcgtattgaaaataagattgttaatctgctggaaccgctggcaacactggcctggacgttgggttttgaataccaccacggcttgctggagaaaatgtggaaagagatcttaaaaaatcatgcccacgacagtatcggctgctgctgtagtgacaaagttcatcgcgaaatcgtcgcccgcttcgaactggctgaagacatggcggataatctgattcgtttctacatgcgcaaaattgccgacaacatgccgcagagcgacgccgacaaactcgtcctgtttaacctgatgccctggccgcgtgaagaagttatcaacaccactgtgcggctgcgcgccagccagtttaatttgcgggacgatcgcggtcagcctgtaccgtattttattcgccatgcccgtgagatcgatccaggcctaatcgatcggcaaatagttcattacggtaattacgatccctttatggagtttgatatacagatcaaccagattgtcccttctatgggctatcgcacgctttatatcgaagcgaatcagcctggcaacgtaattgcggcaaaaagtgacgctgaagggatactggaaaatgctttctggcaaattgcgctcaatgaggatggttctctgcaactggtagataaagacagcggtgtgcgctatgaccgggtattgcaaattgaagaaagctctgatgatggtgatgaatatgactattcacccgcaaaagaagagtgggtaattaccgcagcgaacgcgaaaccgcaatgcgatattattcatgaagcctggcagagcagggctgttatccgctatgacatggcagtgccgctcaatttgtcagaacgcagcgcccggcaatccactggcagagtaggggtggtgttggttgtcactcttagtcataacagcaggcgtattgatgtggatatcaatcttgataaccaggctgacgatcatcgccttcgtgtcctggtccctacaccttttaacaccgacagtgttctggcagatacgcagtttggttcgctaacgcgccccgtgaacgacagtgcaatgaacaactggcagcaagaaggctggaaagaagcgccggttccggtatggaatatgctcaactatgttgccttacaggaagggcgtaacggcatggctgtctttagcgaagggttacgtgaatttgaagtcatcggtgaagagaagaaaacctttgccattacgttgctgcgtggcgtgggcttactgggcaaagaagatctgcttttaaggcctgggcggccttcgggaattaaaatgccagtcccggactcacaactacgtggtctgctttcttgtcgcctaagtttattgagttataccggtacgccaaccgccgctggtgtagctcagcaggcgcgagcatggctgactccagtacagtgttacaacaaaatcccatgggatgtgatgaagctcaacaaagccggattcaacgtgccggaaagttatagtttgttgaaaatgcccccagtgggatgcctgataagcgcacttaagaaagctgaagaccgacaagaagtgattttacggctgtttaatccggctgaatcagcaacctgtgatgcgactgttgctttcagtcgcgaggtgatttcttgctcagaaacgatgatggatgaacacattaccaccgaggaaaatcaaggttcaaatctatcggggccttttttacccggccagtcacggacgttcagttaccggcttgcctgaatagcaatcaaaccgaagccacatatgcgcggccagattgttgacaaagggcgctttgttcatgccggatacggcatgaacgctttattcggtctacaaaagcaggcaaattcaatatattgcagagatgatgtagacactggcaagcgtagcgcatcaggtaattttgcgtttatcttcactctcaagccacgtatatgtggctttatttttaacaaaataataaccctgggtgagttaattataatataattataagttaactaaatgttaatattggcggggtggatttatgcctttattagtaatcctgaaactctgcgtcgtattagccagtgaccaaaaaaagaattaaggtcaaccgtgctgtttttgcttcgtctctttttatctttaattgccaaccgaaactaatttcagccttataactcacacattttaaacataaatgtcactaaagttaccttattgaaacatgattaacataatttgtaggaattgatatttatcaatgtataagtcttggaaatgggcatcaaaaagagataaattgttctcgatcaaattggctgaaaggcggtaatttagctataaattgatcaccgtcgaaaaatgcaaatttgcttcaacaaaaacctgtttattgtaaggattttgcggcgtaatatatacgtgggatcaatttgagtttttattaacatgtttgcaacctttctttacgccgtttttgtgtgcattcacatggtatgatgaaagtgttcaaacaaatttctattggggcatgcgtgtgaccctttctaacggggttcactctcggagtcttcatgcgatgagcaaggagtcatgatgttagatatagtcgaactgtcgcgcttacagtttgccttgaccgcgatgtaccacttcctttttgtgccactgacgctcggtatggcgttcctgctggccattatggaaacggtctacgtcctctccggcaaacagatttataaagatatgaccaagttctggggcaagttgtttggtatcaacttcgctctgggtgtggctaccggtctgaccatggagttccagttcgggactaactggtcttactattcccactatgtaggggatatcttcggtgcgccgctggcaatcgaaggtctgatggccttcttcctcgaatccacctttgtaggtctgttcttcttcggttgggatcgtctgggtaaagttcagcatatgtgtgtcacctggctggtggcgctcggttcaaacctgtccgcactgtggattctggttgcgaacggctggatgcaaaacccaatcgcgtccgatttcaactttgaaactatgcgtatggagatggtgagcttctccgagctggtgcttaacccggttgctcaggtgaaattcgttcacactgtagcgtctggttatgtgactggcgcgatgttcatcctcggtatcagcgcatggtatatgctgaaaggtcgtgacttcgccttcgctaaacgctcctttgctatcgctgccagcttcggtatggctgctgttctgtctgttattgttctgggtgatgaatccggctacgaaatgggcgacgtgcagaaaaccaaactggctgctattgaagccgagtgggaaacgcaacctgcgcctgctgcctttactctgttcggcattcctgatcaggaagaggagacgaacaaatttgcgattcagatcccttacgcactgggcatcattgcaacgcgttccgtggataccccggttatcggcctgaaagagctgatggtgcagcatgaagaacgcattcgtaacgggatgaaggcgtactctctgctcgaacaactgcgttctggttctaccgaccaggcggttcgtgaccagttcaatagcatgaagaaagacctcggttacggtctgctgctgaaacgctatacgccaaacgtggctgatgcgactgaagcgcagattcaacaggcaaccaaagactccatcccgcgtgtagcgccgctgtactttgcgttccgtatcatggtggcgtgtggcttcctgcttctggcaatcatcgcgctctctttctggagtgtcatccgcaaccgcattggcgagaaaaaatggcttctgcgcgccgcgctgtacggtattccgctgccgtggattgctgtagaagcgggctggttcgtggctgaatatggccgccaaccgtgggctatcggtgaagtgctgccgacagctgtggcgaactcgtcactgaccgcaggcgatctcatcttctcaatggtgctgatttgcggcctgtataccctgttcctggtggcagaattgttcttaatgttcaagtttgcacgcctcggcccaagcagcctgaaaaccggtcgctatcactttgagcagtcttccacgactactcagccggcacgctaagacaggagtcgtcaaatgatcgattatgaagtattgcgttttatctggtggctgctggttggcgttctgctgattggttttgcagtcactgacggtttcgacatgggggtgggcatgctcacccgtttcctcggtcgtaacgacaccgagcgtcgaattatgattaactccattgcaccacactgggacggtaaccaggtttggctgatcaccgcgggcggcgcactctttgctgcctggccgatggtctatgccgctgcgttctccggcttctatgtggcgatgatcctcgtgctggcgtctttgttcttccgtccggtcggttttgactaccgctccaagattgaagaaacccgctggcgtaacatgtgggactggggcatcttcattggtagcttcgttccgccgctggtaattggtgtagcgttcggtaacctgttgcagggcgtaccgttcaacgttgatgaatatctgcgtctgtactacaccggtaacttcttccagttgcttaacccgttcggcctgctggcaggcgtggtgagcgtagggatgatcattactcagggcgcaacctatctgcaaatgcgtaccgtgggcgaactgcacctgcgtacccgtgcaacggctcaggtggctgcgctggtgacactggtctgtttcgcactggctggcgtatgggtgatgtacggtatcgatggttatgtcgtgaaatcgacaatggaccattacgcagcctctaacccactgaataaagaagtggttcgtgaagctggcgcatggctggttaacttcaacaacacgccaattctgtgggctattccggcactgggtgtggttctgccgctgctgaccatcctgactgcacgtatggataaagccgcgtgggcgtttgtgttctcctccctgacgctggcctgcatcatcctgacagccggtatcgcaatgttcccgtttgtgatgccgtccagcaccatgatgaacgcaagtctgacaatgtgggatgcaacttccagccagctgacgcttaacgtcatgacctgggttgcggtggttctggtaccgatcattctgctctacaccgcctggtgttactggaaaatgttcggtcgtatcaccaaagaagatattgaacgtaacacccactctctgtactaagtaaggagctaaaaatgtggtatttcgcatggattctgggaacgcttcttgcctgttcgtttggggtaatcaccgcgctggcgcttgaacacgtcgaatcaggcaaagccggtcaagaagacatctgatgagtaagattatcgcgactttgtatgcggtaatggacaagcgccccctgcgggcgctttccttcgtgatggcgcttctgttagcaggatgtatgttttgggacccatctcgttttgccgcgaagaccagtgaactggaaatctggcatggtttattgctgatgtgggccgtctgtgctggtgtgattcacggcgtgggctttcgtccgcagaaggttctttggcaagggattttttgcccattgcttgccgatattgttctcattgtcgggctgattttcttcttcttttaaatcagaattctctttaaaaaattatgggccgctccaggcccataaatttttacgctcccttaacttgccctcattcccaaacctcaatcgcgcgcgtatagtagcagcgtttaaaagctctaacttttgttgcattaccgggatgtaaagtgaatacaacgctgtttcgatggccggttcgcgtctactatgaagataccgatgccggtggtgtggtgtaccacgccagttacgtcgctttttatgaaagagcacgcacagagatgctgcgtcatcatcacttcagtcagcaggcgctgatggctgaacgcgttgcctttgtggtacgtaaaatgacggtggaatattacgcacctgcgcggctcgacgatatgctcgaaatacagactgaaataacatcaatgcgtggcacctctttggttttcacgcaacgtattgtcaacgccgagaatactttgctgaatgaagcagaggttctggttgtttgcgttgacccactcaaaatgaagcctcgtgcgcttcccaagtctattgtcgcggagtttaagcagtgactgacatgaatatccttgatttgttcctgaaggctagccttctggttaaacttatcatgttgattttgattggtttttcaatcgcatcttgggccattattatccagcggacccgtattcttaacgcagcggcgcgcgaagccgaagcgtttgaagataaattctggtctggaatcgaactctctcgcctctatcaagagagccaggggaaacgggataatctgactggttcggaacaaatcttttacagcgggttcaaagagtttgtgcgcctgcatcgtgccaatagccatgcgccggaagccgtagtggaaggggcgtcgcgtgctatgcgtatctccatgaaccgtgaacttgaaaatctggaaacgcacattccgttcctcggtacggttggctccatcagcccgtatattggtctgtttggtacggtctgggggatcatgcacgcctttatcgccctcggggcggtaaaacaagcaacactgcaaatggttgcgcccggtatcgcagaagcgttgattgcgactgcaattggtctgtttgccgctatcccggcagttatggcctacaaccgcctcaaccagcgcgtaaacaaactggaactgaattacgacaactttatggaagagtttaccgcgattctgcaccgccaggcgtttaccgttagcgagagcaacaaggggtaagccatggccagagcgcgtggacgaggtcgtcgcgatctcaagtccgaaatcaacattgtaccgttgctggacgtactgctggtgctgttgctgatctttatggcgacagcgcccatcatcacccagagcgtggaggtcgatctgccagacgctactgaatcacaggcggtgagcagtaacgataatccgccagtgattgttgaagtgtctggtattggtcagtacaccgtggtggttgagaaagatcgcctggagcgtttaccaccagagcaggtggtggcggaagtgtccagccgtttcaaggccaacccgaaaacggtctttctgatcggtggcgcaaaagatgtgccttacgatgaaataattaaagcactgaacttgttacatagtgcgggtgtgaaatcggttggtttaatgacgcagcctatctaaacatctgcgtttcccttgcttgaaagagagcgggtaacaggcgaacagtttttggaaaccgagagtgtcaaaggcaaccgaacaaaacgacaagctcaagcgggcgataattatttcagcagtgctgcatgtcatcttatttgcggcgctgatctggagttcgttcgatgagaatatagaagcttcagccggaggcggcggtggttcgtccatcgacgctgtcatggttgattcaggtgcggtagttgagcagtacaaacgcatgcaaagccaggaatcaagcgcgaagcgttctgatgaacagcgcaagatgaaggaacagcaggctgctgaagaactgcgtgagaaacaagcggctgaacaggaacgcctgaagcaacttgagaaagagcggttagcggctcaggagcagaaaaagcaggctgaagaagccgcaaaacaggccgagttaaagcagaagcaagctgaagaggcggcagcgaaagcggcggcagatgctaaagcgaaggccgaagcagatgctaaagctgcggaagaagcagcgaagaaagcggctgcagacgcaaagaaaaaagcagaagcagaagccgccaaagccgcagccgaagcgcagaaaaaagccgaggcagccgctgcggcactgaagaagaaagcggaagcggcagaagcagctgcagctgaagcaagaaagaaagcggcaactgaagctgctgaaaaagccaaagcagaagctgagaagaaagcggctgctgaaaaggctgcagctgataagaaagcggcagcagagaaagctgcagccgacaaaaaagcagcagaaaaagcggctgctgaaaaggcagcagctgataagaaagcagcggcagaaaaagccgccgcagacaaaaaagcggcagcggcaaaagctgcagctgaaaaagccgctgcagcaaaagcggccgcagaggcagatgatattttcggtgagctaagctctggtaagaatgcaccgaaaacggggggaggggcgaaagggaacaatgcttcgcctgccgggagtggtaatactaaaaacaatggcgcatcaggggccgatatcaataactatgccgggcagattaaatctgctatcgaaagtaagttctatgacgcatcgtcctatgcaggcaaaacctgtacgctgcgcataaaactggcacccgatggtatgttactggatatcaaacctgaaggtggcgatcccgcactttgtcaggctgcgttggcagcagctaaacttgcgaagatcccgaaaccaccaagccaggcagtatatgaagtgttcaaaaacgcgccattggacttcaaaccgtaatcgcgatgttgactgttcggacggtcaacatcaggcaccggttgccacggggttctggtagttttgtgtattttagtttgttaacattctgctaaattatcgtgggccatcggtccagataagggagatatgatgaagcaggcattacgagtagcatttggttttctcatactgtgggcatcagttctgcatgctgaagtccgcattgtgatcgacagcggtgtagattccggtcgtcctattggtgttgttcctttccagtgggcggggcctggtgcggcacctgaagatattggcggcatcgttgctgctgacttgcgtaacagcggtaaatttaatccgttagatcgcgctcgtctgccacagcagccgggtagtgcgcaggaagtacaaccagctgcatggtccgcactgggcattgacgctgtagttgtcggtcaggtcactccgaatccggatggttcttacaatgttgcttatcaacttgttgacactggcggcgcaccgggtactgtacttgctcagaactcgtacaaagtgaacaagcagtggctgcgttatgctggtcataccgccagtgatgaagtgtttgaaaaactgaccggcattaaaggtgcgttccgtactcgtattgcctacgttgttcagaccaacggcggtcagttcccgtatgaactgcgcgtatctgactatgacggttacaaccagtttgtcgttcaccgttcaccgcagccgctgatgtctccggcgtggtcaccagacggttctaaactggcttatgtgaccttcgaaagcggtcgttccgcgctggttattcagacgctggcaaatggcgctgtacgtcaggtggcttcattcccgcgtcacaacggtgcacctgcattctcgccagacggcagcaaactggcattcgccttgtcgaaaaccggtagtctgaacctgtacgtaatggatttggcttctggtcagatccgccaggtgactgatggtcgcagtaacaataccgaaccgacctggttcccggatagccagaacctggcatttacttctgaccaggccggtcgtccgcaggtttataaagtgaatatcaacggcggtgcgccacaacgtattacctgggaaggttcgcagaaccaggatgcggatgtcagcagcgacggtaaatttatggtaatggtcagctccaatggtgggcagcagcacattgccaaacaagatctggcaacgggaggcgtacaagttctgtcgtccacgttcctggatgaaacgccaagtctggcacctaacggcactatggtaatctacagctcttctcaggggatgggatccgtgctgaatttggtttctacagatgggcgtttcaaagcgcgtcttccggcaactgatggacaggtcaaattccctgcctggtcgccgtatctgtgataataattaattgaatagtaaaggaatcattgaaatgcaactgaacaaagtgctgaaagggctgatgattgctctgcctgttatggcaattgcggcatgttcttccaacaagaacgccagcaatgacggcagcgaaggcatgctgggtgccggcactggtatggatgcgaacggcggcaacggcaacatgtcttccgaagagcaggctcgtctgcaaatgcaacagctgcagcagaacaacatcgtttacttcgatctggacaagtacgatatccgttctgacttcgctcaaatgctggatgcacatgcaaacttcctgcgtagcaacccgtcttacaaagtcaccgtagaaggtcacgcggacgaacgtggtactccggaatacaacatctccctgggtgaacgtcgtgcgaacgccgttaagatgtacctgcagggtaaaggcgtttctgcagaccagatctccatcgtttcttacggtaaagaaaaacctgcagtactgggtcatgacgaagcggcatactccaaaaaccgtcgtgcggtactggtttactaagagaattgcatgagcagtaacttcagacatcaactattgagtctgtcgttactggttggtatagcggccccctgggccgcttttgctcaggcaccaatcagtagtgtcggctcaggctcggtcgaagaccgcgtcactcaacttgagcgtatttctaatgctcacagccagcttttaacccaactccagcaacaactttctgataatcaatccgatattgattccctgcgtggtcagattcaggaaaatcagtatcaactgaatcaggtcgtggagcggcaaaagcagatcctgttgcagatcgacagcctcagcagcggtggtgcagcggcgcaatcaaccagcggcgatcaaagcggtgcggcggcatcaacgacgccgacagctgatgctggtactgcgaatgctggcgcgccggtgaaaagcggtaatgcaaacacggattacaatgcagctattgcgctggtgcaggataaatcccgccaggatgacgcaatggtggcatttcagaatttcatcaaaaattaccctgattcaacttacctgccaaacgccaattattggctgggtcagttaaactacaacaagggtaaaaaagatgatgcggcgtactattttgcttcggtagtgaaaaactatccgaagtcaccaaaggctgcagatgcgatgtttaaagtcggcgtcatcatgcaggacaaaggtgacaccgcaaaagcgaaagccgtataccagcaggttatcagtaaataccctggtactgatggcgctaaacaggcacaaaaacgtctgaacgcgatgtaatgcataacacacgaccagaagtcgcattatttctggtcgtgtcgtgcgaatcataagcagttgagtgatctacatcgaaatttttgttgcgctcaagtctgaaatcagtaatatatgccgccgttgccacgggatatcaaacaaaccgaaagcaacgaaaaagtgggtcgttagctcagttggtagagcagttgacttttaatcaattggtcgcaggttcgaatcctgcacgacccaccaatcgctaaggtggaagcggtagtaaaacgtgaaggataacgttgcatgagcaacggcccgaagggcgagacgaagtcgagtcatcctgcacgacccaccactaacatagttagttgtagtatccagcgtagtatcgggtgattagctcagctgggagagcacctcccttacaaggagggggtcggcggttcgatcccgtcatcacccaccaccgggtcgttagctcagttggtagagcagttgacttttaatcaattggtcgcaggttcgaatcctgcacgacccaccagttttaacatcgaagacagatgttaagcgtgtaggataacgttgcgtcagcaacggcccgtagggcgagcgaagcgagtcatcctgcacgacccaccactaatgacggtgggttcggtggaagtagtttgtagtatccagcgcagtatcgggtgattagctcagctgggagagcacctcccttacaaggagggggtcggcggttcgatcccgtcatcacccaccactcgggtcgttagctcagttggtagagcagttgacttttaatcaattggtcgcaggttcgaatcctgcacgacccaccagttttaacatcaaactcagatgttaagcgtgaaggataacgttgcgccagcaacggcccgtagggcgagcgaagcgagtcatcctgcacgacccaccaatcttaaagattggccccgagtaaaaatctttcaggtaacacccgtatgggtcgttagctcagttggtagagcagttgacttttaatcaattggtcgcaggttcgaatcctgcacgacccaccaatttaaaggtggttactggtagagaacgtgaaggataacgttgcgttagcaacggcccgaagggcgagacgaagtcgagtcatcctgcacgacccaccatcctgaatgattaaggcagcataatcccgcaaggggtcgttagctcagttggtagagcagttgacttttaatcaattggtcgcaggttcgaatcctgcacgacccaccaatgtaaaaaagcgccctaaaggcgcttttttgctatctgcgatactcaaagattcgaacctgcagcaggtttgagttgagcgcagcgaaacaacggagccgctcgcggcgacggcccgaagggcgagcgaagcgagtcatcctgcacgacccaccaatgtaaaaaagcgccctaaaggcgcttttttgctattcaggcatcctcaatttcactttgtaaacctgatgacatcgtcagagcttactgtgcaagcaactctatgtcggtggaattaggcgtaaaatgacgcatcctgcacattaggcgtaattcgagtgacttttccccaccattcgactatcttgtttagcatataaaacaaattacaccgataacagcgaatattacgctaatgtcggttttaacgttaagcctgtaaaacgagatggtaagatgagcgtaatgtttgatccagacacggcgatttatcctttccccccgaagccgacgccgttaagcattgatgaaaaagcgtattaccgcgagaagataaaacgtctgctaaaagaacgtaatgcggtgatggttgcccactactataccgatcccgaaattcaacaactggcagaagaaaccggtggctgtatttctgattctctggaaatggcgcgcttcggtgcaaagcatcccgcttctactttgttagtcgctggggtgagatttatgggagaaaccgccaaaattctcagtccggaaaaaacaattctgatgccgacacttcaggctgaatgttcactggatctcggctgccctgttgaagaatttaacgcattttgcgatgcccatcccgatcgtactgtcgtcgtctacgccaacacttctgctgcggtaaaagcgcgcgcagattgggtggtaacttcaagcattgccgtcgaacttattgatcatcttgatagtttgggtgaaaaaatcatctgggcacccgacaaacatctggggcgttacgtgcaaaaacagacgggtggagacattctatgctggcagggtgcctgtattgtgcatgatgaatttaagactcaggcgttaacccgcttgcaagaagaatacccggatgctgccatactggtgcatccagaatcaccacaagctattgtcgatatggcggatgcggtcggttccaccagtcaactgatcgctgctgcgaaaacattgccacatcagaggcttattgtggcaaccgatcggggtattttctacaaaatgcagcaggcggtgccagataaagagttactggaagcaccaaccgcaggtgagggtgcaacctgccgcagctgcgcgcattgtccgtggatggccatgaatggccttcaggccatcgcagaggcattagaacaggaaggaagcaatcacgaggttcatgttgatgaaaggctgcgagagagggcgctggtgccgctcaatcgtatgctggattttgcggctacactacgtggataacgaataataaggcgtaacgttacgctttgggggaaagatggatttttttagtgtgcagaatatcctggtacatataccaataggggcaggcggttatgatctctcatggatcgaagcggtaggcacgatcgccgggttgctgtgtattggccttgccagtctggagaagatcagcaactacttctttggcctgatcaacgtcaccttgtttggcattattttctttcagattcagctgtatgccagcctgctattacaggtgtttttctttgccgcgaatatttacggttggtatgcgtggtcgcgacaaaccagtcagaacgaggcggagttgaaaattcgctggttgccattgccgaaggcactcagctggttggcggtttgcgttgtttcgattggtctgatgacggtatttatcaatccggtgtttgcatttttgacccgcgtggcagtcatgatcatgcaagcattaggattacaggttgtgatgcctgaactgcaaccggacgctttcccgttctgggattcatgcatgatggtgttatctatcgtggcaatgattctgatgacgcgtaagtatgtggaaaactggctgttgtgggtgattattaacgtgattagcgtcgttatttttgcacttcagggcgtttacgccatgtctctggagtacatcatcctgacctttattgcgctcaacggcagccggatgtggatcaacagcgcacgtgaaagaggctcacgcgcgctgtcccattaatggtgatgatgtgaatggccagacaccccttcattcaggtggcagtctggcccatgacaaggttgatattccatctgaatggtggcgtgctcaatctgatagtgatccatcaggtagtgttggatctgatccaacaaggcatcgtgatcgtgtggcgggatcacctgcacatgcaacgtcatcaccggcttctcgcctaccatccatacatgtacatggtgcacattgcggacttccgggatttcccggcacatacgacgcttcagttcagcgatatccagcgataccggtgcaccttcaagtaattcattcacgctatctttcaacagtcgccacgcgctacgcagaaccagaagcgacaccagtatcgagagaatggggtcagcaggtgtccagccagtccagataataatcaacgcggcaataatagccccaaccgaacccagcaggtccccgagcacatgcagtgccgctgctcgtacgttgaggtttttctcttcgctgccgtgatgaagtaaccagaaagaaagtatatttgccagcaacccagccacggcaattgccatcatcatgccgccctcgaccggacgcggcgtgcggaagcgttctatcgcctcccagacaatcaaaatggtaattaccacgagggctatggcattcacaaacgccgcgagcgtggtcagtcttagccaaccgaaagtgtggcgaatggtgggaggacgacgtgaaaattgcacggcgagtagggcgaaaagcagggcggcagtatcggtcaacatatgacccgcatcggccagcaatgccagagaaccagaaagaaaaccaccaacgacttctaccagcataaacccggcagtcacgccgaaagcatacaacaagcgacgagcattattatcttctggcaggtgtgaggacgtgtgtgagtgtgagtgcgccatgacgagtcatcccttaattattctcacttaactttatgacatcatactgcttttagaagtgaaaaattaaaagggagagactccgctctcccattattggctattttgcagggttactgcgtggtaccgtcggttttggtatcgacatcattattgatgccatcaccggtttgtacctttttattgatatccggacagcgaccatctttgcacatggtgttcttgtgctcttcatctttggtcattccgtcattgttcattgaagaaccatccgaatgcagcattgtgccgccagaaccggtatttaccccgttattgtcgacgttatttggcgcgacattttcacgggcgtcaggggctacctggcccgcatcagctgcggcgtttgcctggccgttattagtttgcgctccgctatcggcagccagtgcggcaccgctggcaaggcttagagtggcagtcagaaataatgtggccagttttgtcattttcataggatgctcctgttatggtcgttatgtcggataacctcttccaacagtgcatttgcaggtgaatataaggcattggtttaagatttcagccaggttatgaaacgcagcagagaatcttgaaataattaacaaacaaaggagttacagttagaaattgtaggagagatctcgtttttcgcgacaatctggcgtttttcttgctaattccaggattaatccgttcatagtgtaaaaccccgtttacacattctgacggaagatatagattggaagtattgcattcactaagataagtatggcaacactggaacagacatgaattatcagaacgacgatttacgcatcaaagaaatcaaagagttacttcctcctgtcgcattgctggaaaaattccccgctactgaaaatgccgcgaatacggttgcccatgcccgaaaagcgatccataagatcctgaaaggtaatgatgatcgcctgttggttgtgattggcccatgctcaattcatgatcctgtcgcggcaaaagagtatgccactcgcttgctggcgctgcgtgaagagctgaaagatgagctggaaatcgtaatgcgcgtctattttgaaaagccgcgtaccacggtgggctggaaagggctgattaacgatccgcatatggataatagcttccagatcaacgacggtctgcgtatagcccgtaaattgctgcttgatattaacgacagcggtctgccagcggcaggtgagtttctcgatatgatcaccccacaatatctcgctgacctgatgagctggggcgcaattggcgcacgtaccaccgaatcgcaggtgcaccgcgaactggcatcagggctttcttgtccggtcggcttcaaaaatggcaccgacggtacgattaaagtggctatcgatgccattaatgccgccggtgcgccgcactgcttcctgtccgtaacgaaatgggggcattcggcgattgtgaataccagcggtaacggcgattgccatatcattctgcgcggcggtaaagagcctaactacagcgcgaagcacgttgctgaagtgaaagaagggctgaacaaagcaggcctgccagcacaggtgatgatcgatttcagccatgctaactcgtccaaacaattcaaaaagcagatggatgtttgtgctgacgtttgccagcagattgccggtggcgaaaaggccattattggcgtgatggtggaaagccatctggtggaaggcaatcagagcctcgagagcggggagccgctggcctacggtaagagcatcaccgatgcctgcatcggctgggaagataccgatgctctgttacgtcaactggcgaatgcagtaaaagcgcgtcgcgggtaaggtttaattgtcggatgcgccgtcagagtggcgtatccgatgaatcaccacaggcctgataagtcgcgcagcgtcgcatcaggcaatgtgctccattgttagcaacaaaaaagccgactcacttgcagtcggctttctcattttaaacgaatgacgtttacttcgctttaccctggtttgcaaccgccgctgctttcgctgcgatctcgtcagcattacccagataatagcgtttcagcggtttgaaattctcgtcgaactcatacaccagcggcacgccagtcgggatattaagctcaagaatctcttcttcgctcatgttatcaagatatttcaccagcgcacgtaaagagttaccgtgtgcagcgatgatcacgcgctcaccgctcttcatacgcggcagaatagtttcattccagtaagggatcacgcggtcaatggtcagcgccaggctttccgtcagcggcagttctttctcgctcagtttcgcgtaacgcggatcgtgacccggataacgctcatcatctttagtcagttccggcggagtcactgcaaaaccacgacgccactgtttcacctgctcgtcgccatacttttcagcagtttccgctttgttcagaccctgcaacgcaccgtagtgacgttcgttcagtttccaggatttctcaacgggcagccatgcctgatccagttcgtccagcacattccacagggtatggatagcgcgtttcagcacagaagtgtaagcaaagtcaaagctgtaaccttcctctttcagcagcttacctgctgcttttgcttcgcttacgcctttctcagacagatccacgtcgtaccaaccggtgaaacggttttctttgttccactgactttcgccatgacgaaccagaaccagcttagttacagccatatacttactcctcaaatcatcttttaatgataataattctcattatattgccgcgacgaagcaacagcaatgcttacgcataaccatagcgaaaatagtggcgcagtgtaaggttgttgtgaatattgagttgcaaatatgtcggtgtttgctggtgatttgaacaatatgagataaagccctcatgacgagggcgtaacattactcagcaataaactgatattccgtcaggctggaatactcttcgccaggacgcaggaagcagtccggttgcggccattcagggtggttcgggctgtccggtagaaactcgctttccagagccagcccttgccagtcggcgtaaggttcggttccccgcgacggtgtgccgccgaggaagttgccggagtagaattgcagagccggagcggtggtgtagaccttcagctgcaatttttcatctgctgaccagacatgcgccgccactttcttgccatcgcctttggcctgtaacaagaatgcgtgatcgtaacctttcactttgcgctgatcgtcgtcggcaagaaactcactggcgatgattttggcgctgcggaaatcaaaagacgttccggcgacagatttcaggccgtcgtgcggaatgccgccttcatcaaccggcagatattcgtccgccagaatctgcaacttgtgattgcgcacgtcagactgctcgccgtcaagattgaaatagacgtgattagtcatattcaccgggcaaggtttatcaactgtggcgcgataagtaatggagatacggttatcgtcggtcagacgatattgcaccgtcgcgccgagattacccgggaagccctgatcaccatcatctgaactcagggcaaacagcacctgacgatcgttctggttcacaatctgccagcgacgtttgtcgaacccttccggcccgccgtgcagctggttaacgccctgacttggcgaaagcgtcacggtttcaccgtcaaaggtataacggctattggcgatacggttggcataacgaccaatagaggcccccagaaacgcggcctgatcctgatagcattccgggctggcacagccgagcagcgcctcgcggacgctgccatcggaaagcggaatacgggcggaaagtaaagtcgcaccccagtccatcagcgtgactaccatccctgcgttgttacgcaaagttaacagtcggtacggctgaccatcgggtgccagtgcgggagtttcgttcagcactgtcctgctccttgtgatggtttacaaacgtaaaaagtctctttaatacctgtttttgcttcatattgttcagcgacagcttgctgtacggcaggcaccagctcttccgggatcagcgcgacgatacagccgccaaatccgccgccggtcatgcgtacgccacctttgtcgccaatcacagctttgacgatttctaccagagtgtcaatttgcggcacggtgatttcgaaatcatcgcgcatagaggcatgagactccgccatcaactcgcccatacgtttcaggtcgccttgctccagcgcgctggcagcttcaacggtgcgggcgttttcagtcagtatatgacgcacgcgttttgccacgatcgggtccagttcatgcgcaacagcgttgaactcttcaatggtgacatcacgcagggctggctgctggaagaaacgcgcaccggtttcgcactgttcacgacgggtgttgtattcgctgccaaccagggtacgtttgaagttactgttgatgatgacgacagccacacctttgggcatggaaactgctttggtccccagtgagcggcaatcgatcagcaaggcatgatctttcttgccgagcgcggaaattagctgatccatgatcccgcagttacagcctacaaactggttttctgcttcctgaccgttaagcgcgatttgtgcgccgtccagcggcagatgataaagctgctgcaatacggttccgaccgcgacttccagtgaagcggaagaacttaacccggcaccctgcggcacattgccgctgatcaccatgtccacgccgccgaagctgttgttacgcagttgcagatgtttcaccacgccacgaacgtagttagcccattgatagttttcatgtgcgacaatgggcgcatcgagggaaaactcgtcgagctgattttcataatcggctgccatcacgcgaactttacggtcatcgcgtggtgcacaactgatcacggtttgataatcaatcgcgcagggcagaacgaaaccgtcgttgtagtcggtgtgttcaccaatcaaattcacgcggccaggcgcctgaatggtgtgagtggcagggtagccaaatgcgttggcaaacagagattgtgttttttctttcagactcatttcttacactccggattcgcgaaaatggatatcgctgactgcgcgcaaacgctctgctgcctgttctgcggtcaggtctcgctgggtctctgccagcatttcataaccaaccataaatttacgtacggtggcggagcgcagcagaggcggataaaagtgcgcgtgcagctgccagtgttgattctcttcgccattaaatggcgcgccgtgccagcccatagagtaggggaaggagcactggaagaggttgtcataacgactggtcagctttttcaacgccagcgccagatcgctgcgctgggcgtcggtcaaatcggtgatccgtaaaacgtgggctttgggcagcagtagcgtttcgaacggccaggcagcccagtaaggcacgacggctaaccagtgttcggtttcgacaacggtacggctaccgtctgccagctcgcgctgaacataatccaccagcattggtgatttctgttcggcaaaatattctttttgcaggcggtcttcgcgctcagcttcgttaggcaggaagctatttgcccaaatctgaccgtgcggatgcgggttagagcagcccatcgccgcgcctttgttttcaaaaacctgcacccatgggtacgttttccccagttctgcggtttgctcctgccaggttttgacgatttccgtcaatgctgcaacgctgagctctggcagcgttttactgtgatccggtgaaaagcagatcacccggctggtgccgcgcgcgctctggcaacgcatcagcggatcgtgactttctggcgcatctggcgtgtcagacatcaaagccgcaaagtcattagtgaaaacgtaagtcccggtgtaatcggggtttttatcgcctgtcacccgcacattacctgcgcagaggaagcaatctggatcgtgcgcaggtaacacctgtttggctggcgtttcctgcgccccctgccaggggcgcttagcgcggtgcggtgaaaccagaatccattgcccggtgagcgggttgtagcggcgatgtggatgatcaacgggattaaattgcgtcatggtcgttccttaatcgggatatccctgtggatggcgtgactgccagtgccaggtgtcctgcgccatttcatcgagtgtgcgcgttacgcgccagttcagttcacggtcggctttgctggcgtccgcccagtaggccggaaggtcgccctcgcgacgcggtgcaaaatgataattaaccggtttgccgcaggctttgctgaaggcattaaccacgtccagcacgctgttgcctacgccagcgccgaggttgtagatgtgtacgcctggcttgttcgccagtttttccatcgccacgacgtgaccgtccgccagatccattacgtggatgtaatcgcgtacgccagtaccatcttcggtcggataatcgttaccaaaaatcgccagcgagtcgcgacggcctacagcaacctgggcgatgtatggcatcaggttattcggaatgccttgcggatcttcgcccatatcgcccgacggatgcgcgccaaccgggttgaagtagcgcagcagggcaatgctccagtccggctgggctttttgcagatcggtgaggatctgttccaccatcagcttgcttttgccgtaagggctttgcggtgtgccggtcgggaagctttcaacgtatggaattttgggctgatcgccataaacggtggcggaggagctaaaaataaagtttttgacgttagcggcgcgcatggcgctaatcaggcgcagagtgccgttgacattgttgtcgtaatattccagcggtttttgtaccgattcgcccacggctttcagcccggcgaagtggatcacggtgtcgatagcgtgatcgtgcaggatctcggtcatcaacgcttcgttacgaatatcgccttcaacaaacgttggatgtttgccgcctaaacgctcgataacaggcagtacgctgcgcttactgttacagaggttatcaagaatgatgacatcatgaccgttttgcagtaattgcacacaggtatgacttccaatgtaaccgctaccaccggtaaccagaactctcataattcgctccattaggcttatggtatgaaataaccatagcataacaaagatgcgaaaagtgtgacatggaataaattagtggaatcgtttacacaagaatttagccgttttttatgcgcgattaagtgattataaaacagagggtttatgaatgattgcgctttttatctgaaaaaagacgcggtttcatgcctgcatgcgtcgaaccgttggccggagagggtgctaaggccgcctccggcaaggtcagcactaccgactcaatatatttttgtcagcacatagcgatagagtccaccgtccggcacgaactcaagacgatgggtaatacaggcaggcgcatcttcagcgtggtgcgaaacaaacaacaattgcgtttcaccttcgctaatcagcacatcaacaaaacggcggataagctggcgattcagcggatcaagcccctgtagtggttcatcgagaataagcaacgtcggatgtttcaccagtgcgcggacaatcagcgccagacgctgctgtccccaggaaagactatggaacggagcgtcagccgtgcgtttatcaatgccgagaatatccagccactgctgcaccagtttttgctggcgatccgaaacggcctgataaatgccaatcgaatcaaaatagccagaaagaatcacattacgcacggtagtgctgacccggtaatccagatgcaaactactgctgacgtaaccgatatgctttttgatatcccagatggtttcgccgctgccgcgacgtcgtccgaaaagcgtcaaatcgttgctgtaaccttgcggatgatcgccagtaaccaggcttaataacgtcgattttcctgcaccatttggcccgacaatttgccagtgttcgcctggattcacctgccagctaaggttattaagaatggggcgatcgttataagaaaccacgccattgttcagcacaatgcgcggttcgttggcgggtaaggcgtgacgtgctgaaggttcatccggctccggcagttgcacaccttcaagctgttcactatgcgccagttgcgcgacgagtgcttgttggagcagttcctctttagcgccagtttccgctaacgtgcaatccgccagcacgccagcaaactggacaaactccgggatctcatcgaagcgattgagcaccagtaccagagtaataccggactgatgtaacgaggcgagtcgctcagccagctgctgacgtgaggcaacatccaggccatcgaacggctcatcaagaatcaacaagtcaggctccgacatcagcgcctgacacagcagggtttttcgcgtctcgccagtggaaaggtatttaaagcgtcggtcgaggagggcggtaataccgaactgctgcgccagttgcatgcaacgcggtgcatcctttacttcatcctgaatgatctcagccgtagtgcgtccggtgtcatcttcgccagggccgagcatatcggtgttattccgctgccattcgtcgctgacgagtttttgcaattgctcgaaggagagacgagtgatgtgggaaaactggctttgccgttcacctttcaaaagcggaagttcccccgccagcgcgcgggccagggccgatttcccgcttccattcgaaccgacaaacgcccaactatcacccgcgtttaacgttagctgaggcaattgcagcgtttttgtgtcgctaagacgaaacgtgccttgcaaaatttgcaacgatgacattttatatcccactttgtgcagcgattactgacagggatacgtgtttcataacaaattgtcaacacgcttagcacagcgtggcgataatcacgctgtcggcattaaagtaggccgtgacattctgtccttgctgaagagaagtcgcttcatttaccggcactgtggcgcacagtgtttgcccgtcgggtagcgccattaatacttcgcactgctctgcgccgcgctcaatatgactaataatacccggtaattggttgtcagcgttttgcgcgaccgcctcgtcctgagtaatacctacccacggcgcttttagcaatatcaacacttctttgccttcatccagccccagacgcgcgccgctttgtgcggtaattgcgactttcaggcgtgtttttccgtcagccagtaagacatcaacatgctgttgaacgtcatcatgatcgcgggcggtgatggtaccgaaccactggttacgggcgctggtttgcagtgaaaaacgtgagatcgcggccagcaggctgttcagcggcagggcgtcatcgtcacttaacacatcaaaggctttttgctggatttgcgccagtaagtcatagagctgaatcagtcgctgaccatagcgggtcagtactgcgccgccgccacctttaccgcctgttgcgcgctcgaccagaatatgctcacttaactgattcatctcgttaatggcatcccaggcgcttttatagctaataccggcatctttcgctccctggctaatggaaccggaaagcgcaatgtgttttagtagcgaaatgcggcgcgggtcggcgaataatttttgttggagcttaagggtgagaaggatttcggcctgcataacaatgtcctggcaaaagtcttattgtgacggaaaacgaacgccacgcaaagctgaccgcacaaaaggggagtgcttttctgtgcttagcggttagaatagtctcatgactatatctggagttgaccatgttagagttattaaaaagtctggtattcgccgtaatcatggtacctgtcgtgatggccatcatcctgggtctgatttacggtcttggtgaagtattcaacatcttttctggtgttggtaaaaaagaccagcccggacaaaatcattgattccctgaatgcccgcttagtcgggcattttctttttctcaacttcctgcttttcctgccgatattttttcttatctacctcacaaaggttagcaataactgctgggaaaattccgagttagtcgttatattgtcgcctacataacgttacattaaggggttaccaatggctcgtaaatggttgaacttgtttgccggggcggcactctctttcgctgttgctggcaatgcactggcagatgaagggaaaatcacggtgttcgccgccgcatcactgactaacgcaatgcaggacattgctacgcagtttaaaaaagagaaaggcgtggatgtggtttcttctttcgcttcgtcatctactctcgcccgtcagattgaagcgggtgcgcctgcggatctgtttatttctgccgatcagaaatggatggattatgcggttgataaaaaagcgatcgatacagctacgcgtcagacactgctcggcaatagcctggtcgttgtagcaccgaaagccagcgtgcagaaagatttcaccatcgacagcaaaaccaactggacttcactgctgaatggcggtcgcctggcggttggcgatccggaacatgttcccgctggcatttatgcaaaagaagcactgcaaaaactgggcgcatgggatacgctctctccgaaactggccccagcggaagatgttcgtggggcgctggcgctggtcgaacgtaacgaagcgcctctgggcattgtctacggttctgacgcagttgccagcaaaggggtaaaagtggttgccaccttcccggaagattcacataaaaaagtggaatatccggttgctgttgtggaagggcataacaatgcgacagtgaaagcattttatgattatctgaagggaccgcaggcagcggaaatctttaaacgttacggatttacaatcaagtaatgatactgaccgatccagaatggcaggcagttttattaagcctgaaagtttcttccctggctgtgctgtttagcctgccgtttgggatcttttttgcctggttactggtgcgttgcacgtttccgggcaaagctctgctcgacagcgtactgcatctaccgctggtgttaccgcccgtggtcgtcggttacttattattagtttcgatgggacggcgcggatttatcggtgaacgtctgtatgactggtttggtattaccttcgcctttagctggcgcggcgcggttctcgctgccgccgtcatgtcgtttccgctgatggtgcgggcaattcgtctggcgctggaaggggttgatgtcaaactggaacaggccgcaagaacactgggggccgggcgctggcgcgttttctttactatcacgttaccgctgaccttaccgggaattattgttggtacggtactggcttttgctcgttctctcggtgagtttggtgcaaccatcacctttgtgtcgaacattcctggtgaaacgcgaaccattccttctgccatgtataccctgatccagacccccggcggggaaagtggagcggcgagactgtgcattatttctattgcgctggcgatgatctccctgttgatttcagaatggctggccagaatcagccgtgaacgggcggggcgctaatcatgctggaactgaatttttcccagacgttgggcaaccattgcctgactattaatgaaacgctgcccgccaatggcatcactgctatctttggcgtctccggtgccggaaaaacttcgctgattaacgccatcagtggactgacgcgcccgcaaaaagggcggattgtcctcaatgggcgggtactaaatgatgccgaaaaaggtatctgcctgacgccggaaaagcgtcgcgttggctatgtttttcaggatgcgcggctgttcccgcattacaaagtgcgtggcaatctgcgctacggcatgtcgaaaagtatggtcgatcagttcgataagctggtggcgcttttaggcattgaaccgttgcttgaccgtttaccaggcagcctgtccggaggcgaaaaacagcgcgtggcgattggtcgggctttgctgacagcaccggaattgctgttgctggatgaaccgctggcgtcactggatattccgcgtaaacgcgaactgttgccttatctgcaacggctgacacgggaaatcaacattccgatgttgtatgtcagccattcgctggatgagatcctccatctggcagacagagtgatggtactggaaaacggtcaggtgaaagcctttggcgcgctggaggaagtgtggggcagtagcgtgatgaatccgtggctgccgaaagagcaacaaagtagcattctgaaagtgacggtgcttgagcatcatccgcattacgcgatgaccgcgctggcgctgggcgatcagcatttgtgggtcaataagctggacgaaccgctgcaagctgcgctacgtatccgcattcaggcttccgatgtttctctggttttacaaccgccgcagcaaaccagcattcgtaacgtattgcgggcaaaagttgttaatagttatgacgacaacggccaggtggaagtggaactggaagtcggcggtaaaacgctgtgggcgcgtatcagcccgtgggccagggatgaactggcgatcaaacctggcctgtggctgtacgcgcaaattaaaagtgtgtcgataaccgcctgattaaatcaggtggctataaatgaactgggcaatgctgtcggtggtgttatcaccaatcacaatgttggcgcgcgcttttaccgcgtcatcggcgttgcccatcgccacgcctgtaccagcggcttccagcatactgatatcattaaagttatcgccgaatgccacgacgttttccatcgaccaaccttgcgcctcaacccatttcgtcaaacgtttacctttgctgttgccgccgcgtgcaatatcaacctgatcgtgccaggaccattcacactccagtcccagttcatgttcgacatgcttaccaaaatgctgcaattgcggcaggtcatcgtgcgtcagggcgaacttccatacggcgttaacttgttgcgccgtttcagccagagaagcgacttgtgtgaaagtcggacgctgttccggcggcagggtttgcgcccagttagatgtgcgaatgacatgcccggtcgggtgctcatagaccattgcatcatcgacatacatcagaccgtgaatgtggtgttcattcagcatctcaatgagttgcagggctttaataacgggcattgggtccgcttccagcacggtttttgcatgataatcatacaaataggtgccattacagcaaatagcaggtgtatccagcgccagcgcctgataaaaaggatgaatagcgacgtgatggcgacctgtgacgatgattaattgatagcctgcttcgcgagcgcgggccagggcttctatcgatgaaggaagcagggtctttttcggggtcaataaggtgccgtctaagtcgagagcaatcacgcgtgtggtcatggcgtattccagattaaggttaagaattttcgtctgcgcgaatggtacaccgataccactatcggacaaaattctgcgttttaattcagcattcaccgccaaaagcgactaattttagctgttacagtcagttgctaaatgcaaaggagcattcatgaagcaaacagtttatatcgccagccctgagagccagcaaattcacgtctggaatctgaatcatgaaggcgcactgacgctgacacaggttgtcgatgtgccggggcaggtgcagccgatggtggtcagcccggacaaacgttatctctatgttggtgttcgccctgagtttcgcgtcctggcgtatcgtatcgccccggacgatggcgcactgacctttgccgcagagtctgcgctgccgggtagtccgacgcatatttccaccgatcaccaggggcagtttgtctttgtaggttcttacaatgcgggtaacgtgagcgtaacgcgtctggaagatggcctgccagtgggcgtcgtcgatgtggtcgaggggctggacggttgccattccgccaatatctcaccggacaaccgtacgctgtgggttccggcattaaagcaggatcgcatttgcctgtttacggtcagcgatgatggtcatctcgtggcgcaggaccctgcggaagtgaccaccgttgaaggggccggcccgcgtcatatggtattccatccaaacgaacaatatgcgtattgcgtcaatgagttaaacagctcagtggatgtctgggaactgaaagatccgcacggtaatatcgaatgtgtccagacgctggatatgatgccggaaaacttctccgacacccgttgggcggctgatattcatatcaccccggatggtcgccatttatacgcctgcgaccgtaccgccagcctgattaccgttttcagcgtttcggaagatggcagcgtgttgagtaaagaaggcttccagccaacggaaacccagccgcgcggcttcaatgttgatcacagcggcaagtatctgattgccgccgggcaaaaatctcaccacatctcggtatacgaaattgttggcgagcaggggctactgcatgaaaaaggccgctatgcggtcgggcagggaccaatgtgggtggtggttaacgcacactaaccgctgatttacccggcgcagtctctcctgcgccggtgtattaacctatctcctgtaacgcgtgtctctggcgttcgacgatattggtccacaaattgtctttatcgtcagtccataaattaatcagcaaggcaaaaaagcgttctgctgctggagaaagtacggcatctttacggcgaattattcccaatgttcgacgtataacgggttccaccaatgggataccaataatcgaagaatagggcgcatgaggcattgccaggccaggaagcgccgaaatccccagtcccgcctccaccagtcctaatgacgtcgaaagatgacgcacttcgtaaaaccagtccagcttccagggcttgtcggccagctgttgttctatcaacagtcggttgccgctggaggagcgtacgccaatcattttgtaacccactaactcctgccattctacaagctgctttttggccaatggatggtcacgccgacaggccagcacgaacggctcgttgaccagtggggtaaaatcaatggatgaatttgtgacgttgttcatgtttatgccaaagtctgattcgttacacagcaccgattccatgcaattattcgtgccttgttccagaatccgcactttaatattgggatacagctcattaaatttaccgattgccagcggtaaaaaataaaatactgcggtcggaatacacgctaacgtcaccataccacgatgataagcattcatatcacgaatattaaaaagcgtttcatcgaatttctttattaattcccgcgcctccgggagcaacctttttcctgcttttgttaacgtaaccttgcgagttgtacgctcaaatagttgaacatgtaaatcttcctccatcttttttattcttcgcgttaatgcaggttgcgtaatattgagtaatttagcggcattgttaaacgaactggactctgccagtatgacaaatgccttcatacttgataattcatgcttcattattactccggaaaatggaagcgacgattttgggtggctggccgttaaaaattttaactgcatttagccaacttaaattaatgaaaaaatgttattaatcgttgagctaaagtcattagagatgctttgcccttaatgtaaccatatcgcaataagttatgtttttaaattgagggcattattatgaaaaaaataccctgcgtgatgatgcgaggtggaacctcgaggggcgcgttcctgttagcggaacatttacccgaagatcaaacgcagcgcgataaaatattgatggcaattatgggttccggtaacgatctggaaattgacggtattggcggcggtaatccactgaccagtaaagtcgccattattagccgttccagcgatccgcgtgctgatgtcgattatctgtttgcgcaggtaatcgttcatgagcaacgtgtcgataccacgcctaactgcggcaatatgctgtctggtgttggggcattcgccattgaaaatggtttgattgcagcgacttcgccagttactcgcgtacgtatccgcaacgtcaatacgggtacgttcatcgaagctgatgtgcaaacgccaaatggtgttgtcgagtacgagggtagcgccagaattgacggcgtaccgggtactgccgcaccggttgcgctcactttcctgaatgccgctggaaccaaaaccggaaaagttttcccgactgataatcagattgattattttgacgatgtcccggtgacctgtatcgatatggcgatgccagtcgtcattattccggctgaatatctgggaaaaacaggttatgaattaccggcggaactggatgccgacaaagcattattagcccgcattgaatctatccgtctacaagcgggtaaagcaatgggcttaggtgatgtcagtaatatggttatccctaaacctgtgcttatttctccagcgcagaaaggcggggcaattaatgtgcgttattttatgccgcattcttgccatcgcgcgctggcgataaccggtgctattgctatttccagtagttgtgcattggaaggcaccgtcacccgacaaatcgtcccttctgtaggatacggcaatatcaatattgaacaccccagtggtgcgctcgacgttcatttaagtaatgaaggtcaggatgccacgacgttacgcgcatctgttattcggacgaccagaaaaatattttccggtgaagtttatcttccctgaaaaaattcgttgtcaggataaggacaatcaataaaggacttctgtatgagtcatacagaaagaacaggattttaaatgaataagaaatcgttatggaagctaattctgatattagcgatcccatgtattattggttttatgccagctccggcaggattaagcgaactggcgtgggtgctttttggtatttacctggcggccattgtggggctggttatcaagcctttcccggaacctgtcgtactgttaattgccgttgctgcctcaatggtggtggtcggtaacttatccgacggtgcgtttaaaaccaccgccgtattaagcggttactcttcaggtaccacctggctggtgttctcggcgtttaccttaagcgccgcatttgtgaccaccggtttaggtaaacgtattgcctatctgctgattggtaaaatcggtaacaccacgctgggtctgggttacgttacggtattcctcgatctggtactggctccggcaacaccgtctaacaccgcgcgtgcgggcggcattgtgttaccgatcatcaacagcgtggcggtggctttggggtccgaaccggaaaaaagtccgcgtcgtgtcggacattacctgatgatgtccatttacatggtcaccaaaaccaccagctatatgttctttaccgcaatggcggggaacattctggcgctgaaaatgatcaacgacattctgcacctgcaaattagctggggtggatgggcgctggcagccggattgccgggcatcattatgctgctggtcaccccgctggtgatttacaccatgtatccaccagaaattaagaaggtggataacaaaaccatcgctaaagcgggccttgccgaactaggaccgatgaaaatccgcgaaaaaatgctgctcggtgtctttgtgctggcgctgctgggctggattttcagtaagtctctgggggttgatgaatccaccgtggcaatcgttgttatggcaaccatgctgctgctgggtatcgttacctgggaagacgtggttaaaaataaaggcggctggaataccttaatctggtacggcggtattatcggcttaagctccttattatcgaaagttaaattcttcgaatggttagctgaagtctttaaaaataacctggcatttgatggtcacggtaacgttgctttcttcgttattattttcctcagcattatcgtgcgttatttcttcgcttccggtagtgcctatatcgttgctatgttaccggtatttgccatgctggcgaacgtctccggcgcaccgttaatgttaaccgcgctggcactgttgttctccaactcctatggcggcatggttactcactatggcggcgcggcaggtccggtcatctttggcgtgggttataacgatattaaatcctggtggttggtcggtgcggtactgacgatattaaccttcctggtgcatatcaccctcggcgtgtggtggtggaatatgctgatcggctggaacatgctgtaaatattctcgtcatacttcaagttgcatgtgctgcgtctgcgttcgctcaccccagtcacttacttatgtaagctcctggggattcactcgcttgtcgccttcctgcaactcgaattatttagagtatatccatttattatctttctgcgcacttcacggtgcgcagatatctggagcatttgatgatcaagttatctgaaaaaggcgtgtttctcgccagtaataacgaaataattgccgaagaacatttcaccggcgaaattaaaaaagaagaagccaaaaaaggcactattgcctggtctattctctcttcgcataatacgtccggaaatatggataaacttaaaattaagtttgattcattagcctctcacgatattacctttgttggtattgtacagaccgctaaagcgtccggtatggaacgtttcccgctgccgtatgtgctgaccaactgccataactcactctgcgccgtcggcggcactattaacggtgatgaccatgtttttggtttatcggcggcccagcgttatggcggtatttttgtgcctccgcatattgcggtcatccatcaatatatgcgtgagatgatggcaggcggcggcaaaatgatcctcgggtcagacagccacacccgttacggtgcattagggacaatggcagtcggtgagggcggcggtgagttggtaaaacagctgcttaatgacacctgggatatcgactatccgggcgtggttgcggtgcatctgaccggaaaacctgcgccgtatgtggggccacaggatgtggcgctggctatcattggcgcggtgttcaaaaacggttacgtcaaaaacaaagtcatggagttcgttggaccgggcgttagcgcgctctctaccgatttccgtaacagcgttgacgtgatgaccactgaaacgacctgtttaagttctgtctggcaaaccgatgaagaagtccataactggctggcgctgcacggtcgcggccaggattactgccagcttaaccctcaaccgatggcgtactacgatggctgcatcagcgttgatttaagcgccatcaaaccaatgattgcgctgccgttccacccgagcaacgtgtatgaaatcgacacactgaaccagaacctgaccgacattctgcgtgagattgaaattgagtccgaacgcgtggcgcacggtaaagccaaactctcgctgctggataaagtggaaaatggtcgcctgaaagtgcagcaggggattatcgcgggctgttctggcggtaactacgaaaacgtcatcgcggcggcgaatgcactgcgcggtcaatcctgtggcaatgacaccttctcgctggcagtttacccgtcatcacagccggtgtttatggatctcgccaaaaaaggtgtggtagcagatttgattggcgcaggcgcaatcatcagaaccgcgttctgcggcccatgctttggcgcgggcgatacgccaatcaacaacggtttgagtattcgccacaccacgcgtaacttcccgaaccgcgaaggctctaagccagctaatgggcagatgtcagcggtggcgttgatggacgctcgttctatcgctgcgactgcggcaaacggtggctatttaacctctgccagcgaacttgattgctgggacaacgtgccggagtacgccttcgatgtaacgccgtataaaaaccgtgtttatcagggctttgtgaaaggggcaactcagcaaccgctgatttacgggccgaacattaaagactggccggaattgggtgcgctgactgacaatatcgtcctgaaagtgtgctcgaagatcctcgacgaagtgaccaccaccgacgaactgattccttccggtgaaacctcttcttatcgttcaaatccgattggtctggcggagtttaccctgtctcgccgcgatcccggttatgttagcagaagtaaagcgactgctgagctggaaaatcagcgtctggcggggaatgtcagcgagctgacagaggtgtttgcgcgcattaagcagattgctggtcaggagcatattgatccgctgcaaactgaaattggcagcatggtctatgcggtgaaaccaggcgatggttctgcgcgtgaacaggcggcgagctgccagcgtgtgattggcggtctggcgaatattgccgaggagtacgcgactaaacgctatcgttctaacgtcatcaactgggggatgttaccgctgcaaatggcggaagtaccaacctttgaagtgggggattacatttacatccctggcattaaagcggcgctggataatccgggtacgacgtttaaaggttatgtgatccatgaagatgcgccggtaacggaaattacgctctatatggaaagtctgactgctgaagagcgcgagattatcaaggcgggtagtttgattaacttcaataaaaaccgtcagatgtaaaaagcgccatgtgaatgtaggtcgcattcggcacttattgtcggatgcgatgcttgcgcatcttatccgacctacgaatcgcatcgaatctgtaggccagataaggcattttcgcagcatccggcacttattgtcggatgcgatgcttgcgcatcttatccgacctacaaatcgcatcgaaccgtaggccggataaggcgtttacgccgcatccggcaaatagttaattgctcttacttcttcgcctctgcaaccactttactacccacgccgcggttattgtattcccacatgcggttgtagttagtgtcattcagattgcgctgtatttcgtcgttatcatctacgctgccggtattacccgcaaacggacgattagagatcaccgcatcggcccacggtttagccgtgttaaaaccttcgttgatggcgctatcacggatcaccacctgaccgttggtattggcatcaacatccagcgagcggcccagttgcgccacaccatcaccgaaagcattgaaacggctgtttacggcgaggaaaccgtagtaaatgttggacagcgtagccggtgcaaacacatacgcttcttgctgagtacgtgagttcaccacgcggaattcggtgttatcgaacaccactgcgccgcgaccagaaacgatatccacatccccttcaatgtagctgttggtcaccagcgtacgcggctgacgattcgtttccagacggttctgcacaccgctgttggtgacaaagaaggtgttctgacgaccgagaatgttaacgttgttaatctgtacctggtcaccatcagtacgcagtgccaccgccggatggttacctgcatctacgctatcgcccagcgtgttttcgatggtcagattttgcagttgcaggccattgttttgtgaccagaagaccgcagagcagagaacaccgatactgtcgctgcgtttgctctggcagctatcgtacatataccacgctggtttacctggcatatatttgccgcgcgggttgacgtcgtgacgccagtcggcagggctcatgccaccatcaagggaaagcccaatcttcacatcaatcggtttttcacctgtaccgtacagagtaattccacccggagcggcagggacatataccgttccctgatactcaccaggcatcacggcaatatactggcgcttgttggtacgcttgataattgccgcatctaccgccgcctgaatcgtggtatgcgttacaccttgagtgcccgccgggccgacaacaaagtcaggttgcgcaggcagggtaatcggggaaggattccacgctgcagcacctggtgtcagggatgcaaaatagtgttgagcatcgaaattctgcgcttcttttgccgacagaatcgggcgagaagaggtaccaggcgcggtttgatcagaaggacgttgatcgggcggggttgagctacaggcggtcagcgtcacgccaaaagccaatgccagcgccagacgggaaactgaaaatgtgttcacaggttgctccgggctatgaaatagaaaaatgaatccgttgaagcctgcttttttatactaacttgagcgaaacgggaaggtaaaaagacaaaaagttgtttttaatacctttaagtgataccagatggcattgcgccatctggcagagtgattaactaaacatcgcagtaatcgaggcgcttgccagagagtggaaatgaacgttaaacccgaccatcgcgccgctggcaccttcatcgacatcaatacgttctatatccagcgcgtgaacggtaaaaatgtagcgatgagtttcgcctttcggcggtgctgcgccatcgtacccggttttaccaaagtcggtacgcgtctgcaaaacgccgtctggcattgctaccagaccagagccaaacccttgcggtaatacgcgggtatcagcgggtaagttaacaactacccagtgccaccagccggagccggttggcgcatccgggtcgtagcaggtgacaacaaaacttttcgttcccgcaggaacatcatcccacgccagatgcggtgaaatattatcgccatcgtaacccatgccgttaaagacatgacgatgcggcaatttatcgccatcgcgcagatcgttactgatgagtttcatgaaccctcctttcttgtttgcagaaagtgtagccagaaaccctcacgcggacttctcgttattggcaaaaaaatgtttcatcctgtaccgcgcggttaaccgctgcggtcagacgctgcaactgttgcgggagaataatatagggcggcatcaggtaaatcagtttgccaaaaggccggatccagacaccctgttcgacaaagaatttttgcagcgccgccatattcaccggatgagtggtttcgaccacgccaatggcccccagtacgcgcacatcggcaaccatttcggcatcacgggcgggggcaagttgctcgcgcagctgtacttcaatatccgccacctgttgctgccagtcgccagattcgagaatcgccaggctggcgtttgctgccgcgcaggccagcggattgcccataaaagttggcccatgcataaagcaaccggcttcaccgttactgatggtttctgcaacctcgcgcgtggtgagtgtggcggaaagggtcattgtgccgccggttaaggctttaccgaggcacaaaatgtccggcgcgatttctgcatgttcacaggcaaacagtttcccggtacgaccaaatccagtggcgatctcgtcggcaatcagcaagataccttcgcgatcgcatattttgcggattcgttttaaccattccggatggtacatgcgcatcccgcctgcgccctggacaatcggctcaatgatcaccgccgcgatttcatgacgatgcgccgccatcaggcgggcaaagcccaccatatcgcgctcatcccattcgccatccatgcggctttgcggggcgggagcaaacaggttttctggcaggtagcctttccacagactgtgcattgagttatccggatcgcacaccgacatcgcgccaaaggtatcgccatgataaccattgcggaaggtcagaaaacgctggcgcgcttcgcctttggcttgccagtactgcaacgccattttcatcgccacttccaccgctacggaaccggagtccgcgagaaaaacgcactccagcggttgcggcgtcatcgccaccagtttgcggcacagctcaatggctggcgcatgggtgataccgccaaacatcacatgcgacatggcatcaatttgcgacttcatcgccgcattaagctgcgggtgattgtagccgtggatcgccgcccaccaggacgacataccgtcaaccaggcgtctgccgtcagacaaaatcagctcgcaaccttcggcgctcaccaccggataaaccggcagaggggaggtcatggatgtgtatgggtgccagatatggcgttggtcaaaggcaagatcgtccgttgtcataatcgacttgtaaaccaaattgaaaagatttaggtttacaagtctacaccgaattaacaacaaaaaacacgttttggagaagccccatggctcaccgcccacgctggacattgtcgcaagtcacagaattatttgaaaaaccgttgctggatctgctgtttgaagcgcagcaggtgcatcgccagcatttcgatcctcgtcaggtgcaggtcagcacgttgctgtcgattaagaccggagcttgtccggaagattgcaaatactgcccgcaaagctcgcgctacaaaaccgggctggaagccgagcggttgatggaagttgaacaggtgctggagtcggcgcgcaaagcgaaagcggcaggatcgacgcgcttctgtatgggcgcggcgtggaagaatccccacgaacgcgatatgccgtacctggaacaaatggtgcagggggtaaaagcgatggggctggaggcgtgtatgacgctgggcacgttgagtgaatctcaggcgcagcgcctcgcgaacgccgggctggattactacaaccacaacctggacacctcgccggagttttacggcaatatcatcaccacacgcacttatcaggaacgcctcgatacgctggaaaaagtgcgcgatgccgggatcaaagtctgttctggcggcattgtgggcttaggcgaaacggtaaaagatcgcgccggattattgctgcaactggcaaacctgccgacgccgccggaaagcgtgccaatcaacatgctggtgaaggtgaaaggcacgccgcttgccgataacgatgatgtcgatgcctttgattttattcgcaccattgcggtcgcgcggatcatgatgccaacctcttacgtgcgcctttctgccggacgcgagcagatgaacgaacagactcaggcgatgtgctttatggcaggcgcaaactcgattttctacggttgcaaactgctgaccacgccgaatccggaagaagataaagacctgcaactgttccgcaaactggggctaaatccgcagcaaactgccgtgctggcaggggataacgaacaacagcaacgtcttgaacaggcgctgatgaccccggacaccgacgaatattacaacgcggcagcattatgagctggcaggagaaaatcaacgcggcgctcgatgcgcggcgtgctgccgatgccctgcgtcgccgttatccggtggcgcaaggagccggacgctggctggtggcggatgatcgccagtatctgaacttttccagtaacgattatttaggtttaagccatcatccgcaaattatccgtgcctggcagcagggggcggagcaatttggcatcggtagcggcggctccggtcacgtcagcggttatagcgtggtgcatcaggcactggaagaagagctggccgagtggcttggctattcgcgggcactgctgtttatctctggtttcgccgctaatcaggcagttattgccgcgatgatggcgaaagaggaccgtattgctgccgaccggcttagccatgcctcattgctggaagctgccagtttaagcccgtcgcagcttcgccgttttgctcataacgatgtcactcatttggcgcgattgcttgcttccccctgtccggggcagcaaatggtggtgacagaaggcgtgttcagcatggacggcgatagtgcgccactggcggaaatccagcaggtaacgcaacagcacaatggctggttgatggtcgatgatgcccacggcacgggcgttatcggggagcaggggcgcggcagctgctggctgcaaaaggtaaaaccagaattgctggtagtgacttttggcaaaggatttggcgtcagcggggcagcggtgctttgctccagtacggtggcggattatctgctgcaattcgcccgccaccttatctacagcaccagtatgccgcccgctcaggcgcaggcattacgtgcgtcgctggcggtcattcgcagtgatgagggtgatgcacggcgcgaaaaactggcggcactcattacgcgttttcgtgccggagtacaggatttgccgtttacgcttgctgattcatgcagcgccatccagccattgattgtcggtgataacagccgtgcgttacaactggcagaaaaactgcgtcagcaaggctgctgggtcacggcgattcgcccgccaaccgtacccgctggtactgcgcgactgcgcttaacgctaaccgctgcgcatgaaatgcaggatatcgaccgtctgctggaggtgctgcatggcaacggttaataaacaagccattgcagcggcatttggtcgggcagccgcacactatgagcaacatgcagatctacagcgccagagtgctgacgccttactggcaatgcttccacagcgtaaatacacccacgtactggacgcgggttgtggacctggctggatgagccgccactggcgggaacgtcacgcgcaggtgacggccttagatctctcgccgccaatgcttgttcaggcacgccagaaggatgccgcagaccattatctggcgggagatatcgaatccctgccgttagcgactgcgacgttcgatcttgcatggagcaatctcgcagtgcagtggtgcggtaatttatccacggcactccgcgagctgtatcgggtggtgcgccccaaaggcgtggtcgcgtttaccacgctggtgcagggatcgttacccgaactgcatcaggcgtggcaggcggtggacgagcgtccgcatgctaatcgctttttaccgccagatgaaatcgaacagtcgctgaacggcgtgcattatcaacatcatattcagcccatcacgctgtggtttgatgatgcgctcagtgccatgcgttcgctgaaaggcatcggtgccacgcatcttcatgaagggcgcgacccgcgaatattaacgcgttcgcagttgcagcgattgcaactggcctggccgcaacagcaggggcgatatcctctgacgtatcatctttttttgggagtgattgctcgtgagtaaacgttattttgtcaccggaacggataccgaagtggggaaaactgtcgccagttgtgcacttttacaagccgcaaaggcagcaggctaccggacggcaggttataaaccggtcgcctctggcagcgaaaagaccccggaaggtttacgcaatagcgacgcgctggcgttacagcgcaacagcagcctgcagctggattacgcaacagtaaatccttacaccttcgcagaacccacttcgccgcacatcatcagcgcgcaagagggcagaccgatagaatcattggtaatgagcgccggattacgcgcgcttgaacaacaggctgactgggtgttagtggaaggtgctggcggctggtttacgccgctttctgacactttcacttttgcagattgggtaacacaggaacaactgccggtgatactggtagttggtgtgaaactcggctgtattaatcacgcgatgttgactgcacaggtaatacaacacgccggactgactctggcgggttgggtggcgaacgatgttacgcctccgggaaaacgtcacgctgaatatatgaccacgctcacccgcatgattcccgcgccgctgctgggagagatcccctggcttgcagaaaatccagaaaatgcggcaaccggaaagtacataaaccttgccttgttgtagccattctgtatttggttaaattgcgagcgagatcgcgtcttcgattgactgcaatttaaccaattaaattctaaaataatcacgaaaaaaattttacttccgcctcatgcggcgaatgtgggaattgcccaggcggcgggggataggggctggagacagttatccactattcctgtggataaccatgtgtattagagttagaaaacacgaggcaagcgagagaatacgcggcttgcacgcgaattggcgttaaagacggctcaaagaaatatcttttattttttaactggttagataaatgcaatggcagtcactgaacaggcatctcttgccataaaactgtcatcactcatcttgacaaatgttaaaaaagccgttgctttggggataacccggtaaggccggagttttatctcgccacagagtaaattttgctcatgattgacagcggagtttacgctgtatcagaaatattatggtgatgaactgtttttttatccagtataatttgttggcataattaagtacgacgagtaaaattacatacctgcccgcccaactccttcaggtagcgactcatgagtaaaccgttcaaactgaattccgcttttaaaccttctggcgatcagccagaggcgattcgacgtctcgaagaggggctggaagatggcctggcgcaccagacgttacttggcgtgactggctcagggaaaaccttcaccattgccaatgtcattgctgaccttcagcgcccaaccatggtacttgcgcccaacaaaacgctggcggcccagctgtatggcgaaatgaaagagttcttcccggaaaacgcggtggaatatttcgtttcctactacgactactatcagccggaagcctatgtaccgagttccgacactttcattgagaaagatgcctcggttaacgaacatattgagcagatgcgtttgtccgccaccaaagcgatgctggagcggcgtgatgtggttgtggtggcgtctgtttccgcgatttatggtctgggcgatcctgatttatatctcaagatgatgctccatctcacggtcggtatgattatcgatcagcgcgcgattctgcgccgactggcggagctgcaatacgctcgtaatgatcaagcattccagcgtggtactttccgcgttcgtggcgaggtgatagatatcttcccggcagaatcggatgacattgcacttcgcgtggaactgtttgacgaggaagtggaacgattgtcgttatttgacccgctgaccgggcagattgtttccactattccacgttttaccatctacccgaaaacgcactacgtcacaccgcgcgagcgcatcgtacaggcgatggaggagatcaaagaagagctggccgccagacgcaaagtgctgttggaaaacaacaaactgctggaagagcagcggctgacccagcgtacccagtttgatctggagatgatgaacgagctgggctactgttcggggattgaaaactactcgcgcttcctctccggtcgtggaccgggtgagccaccgccgacgctgtttgattacctgcctgccgatgggctgctggtcgtcgatgaatctcacgtcaccattccacaaattggcggcatgtatcgcggtgaccgggcgcgtaaagagacactggtggagtacggcttccgcctgccatcagcgctggataaccgtccgcttaagtttgaagagttcgaagcattagcgccgcaaaccatctatgtttcggcgacgccgggtaattacgagctggaaaaatccggcggcgatgtggtggatcaggtggtgcgtccaaccggattgcttgacccgattatcgaagtgcggccggtggcgacacaggttgatgatcttctttcggagattcgtcagcgagcggcaattaacgaacgcgtactggtcaccacactgaccaagcggatggcggaagatcttaccgaatatctcgaagaacatggcgagcgcgtgcgttatcttcactcagatatcgacaccgtcgaacgtatggagattatccgcgacttgcgtctgggtgagttcgacgtgctggtagggatcaacttactgcgcgaaggtctggatatgccggaagtgtcgctggtggcgatcctcgacgctgacaaagaaggcttcctgcgttccgaacgttcgttgatccagaccattggtcgtgcggcacgtaacgttaacggtaaagcgattctctacggcgataagatcaccccatcaatggcgaaagcgattggcgaaaccgaacgtcgccgtgagaaacagcagaagtacaacgaggaacacggaattacgccgcaaggcttgaacaagaaagtggtcgatatcctggcgctggggcagaacattgccaaaaccaaagcgaagggcagaggaaaatcgcgcccgattgttgagccggataatgtgccgatggatatgtcgcctaaagcgttgcagcagaaaatccatgagctggaagggttgatgatgcaacacgcgcagaatctggagttcgaagaagcggcgcaaattcgtgaccagttgcatcagctgcgtgagctgtttatcgcggcatcgtaacaggatagcgaagaagactgatgacaaacggaaaacagcctgatgcgctacgcttatcaggcctacattttctccgcaatatattgaatttgcgcggtttgtaggccggataaggcgttcacgccgcatccggcataaacaacgcgcactttgtcttcaataggaagccggaattttccttcggatttccgttaacctaaagcctgtaacgccttttccagcgcgttatgtaacaactggcggtcatgacgatacggaatatcgctggcctccagtacctcctggatcacaatccgctctttcaccgccgagacatccacttttggcccgacgatgaccgcatcaatgacctttttaccaacatactgctccataattgccagcttgctttccagcttcaaattagccgcaggtaaactcaactcacgccccagattgccgatataaaccatcggcgctggcgtgcggcgtaatgcctgggcgatttccttcagcagcagaattggcatcaggctggtataaaaactgccaggcccaataatgatgagatccgcttcattgatagcgtgaaccgcctcacgcgttgcgggtacattaggcgttaacaataactcttgaatcggcgtagttaactggtcgatattgacctcgccgtaaacttcatgcccctgatcgtcaatcgccatcagatcaacaggatgctctgacattggaatcaaatgcgtatccactttcagcagattacgaattaaattgatggcttccagaggccgcacgctaaggtgatccagcgcctttaacatcaagtttccgagattatgaccggaaagttcgccattgccaccaaaacggtattcaaacatcgcggaggcgacgctcggttccgttatcagctggttgaggcagttgcgcatatcgccccaggcaatgccgccttctgaacggcgaatacgccccgtcgagccaccattatcggtggtggtgacgatacccgttaaacgagaacccaaagacgaaagtgatgagagaacgcgtcccagtccatgccctccgccgagagcaacgacacgatcaagatcagccagcgtacgattgcgcatatagtttcctggagtcagattatccgcgctacagtagcgcaaattgcggggaaacagcaattaacctgccaatattgaggatacaaactattttcttctacctctaaaggacgatgcacgctatgcctccctgatgatgtatatcaaagtaaaaccgccattttcccttattctgtagcgaaatagcacgatcatgacgctatatacatgattacatagcgaaagtgtggatggtaaaaatctcatttacacgctagtatcggcataaccactaaacactctagcctctgcacctgggtcaactgatacggtgctttggccgtgacaatgctcgtaaagattgccaccagggcgaaggaagaaatgacttcgcctcccgtatctggaaaggtgtacatggcttcacaactgactgatgcatttgcgcgtaagttttactacttgcgcctgtcgattaccgatgtgtgtaactttcgttgcacctactgcctgccggatggctacaaaccgagcggcgtcaccaataaaggctttcttaccgtcgatgaaattcgccgggttacgcgcgccttcgccagactgggcaccgaaaaagtgcgcctgacaggaggagagccgtctttacgccgcgactttaccgatatcatcgccgctgtgcgggaaaacgacgctatccgccagattgcggtcacaaccaatggttaccgtctggaacgcgatgtggcgagctggcgcgatgcgggacttactggcattaacgtcagtgtcgacagtctggacgcccgccagtttcacgctattaccgggcaggataaattcaaccaggtcatggcagggattgatgctgcatttgaggccggttttgagaaggtcaaagtcaataccgtgctgatgcgtgatgttaatcatcaccagctcgacacctttctgaactggatccagcatcgccctatccagctgcgtttcatcgaactgatggaaacgggcgagggcagcgagctcttccgtaagcatcacatctctggtcaggttctgcgtgacgagctactgcgtcgcggctggatccaccaattacgtcaacgcagcgacggtcccgcgcaagtcttttgccatccagattacgccggagagattggccttatcatgccgtatgaaaaagacttctgcgccacttgcaaccgcctgcgcgtttcctccattggtaaactccatctctgcctgtttggtgaaggcggcgttaacctgcgcgatctgctggaagacgatacccagcaacaggcgctggaagcgcgtatttcagcggcgctgcgggagaagaaacagacccatttcctgcatcaaaacaacaccggtattacgcaaaacttatcgtacattggcggctaaaacgtcaaaaggagagatcagatgagtcaggtaagcactgaatttatcccgacccgtattgctattcttacggtttctaatcgtcgcggtgaagaagacgatacctccggtcactatctgcgcgattcggcgcaagaagcgggccatcacgttgtcgataaagccattgtgaaagaaaaccgctacgctattcgcgctcaggtatctgcgtggatcgccagcgacgatgtacaagtggtattgattacgggtggtactggcctgacggaaggtgatcaggctcccgaagcattgctgccgttgttcgaccgtgaagttgaaggttttggtgaagtgttccggatgttgtcgtttgaagagattggcacttccacgttgcaatctcgtgcggtagcgggcgtcgccaacaaaacgctgattttcgccatgccgggttcgaccaaagcgtgccgtaccgcatgggaaaatatcatcgcgccgcagctggatgcccgtacgcgtccgtgtaatttccatccacatttgaagaaataagtatgtcgcaactgacccatatcaacgccgctggcgaagcgcacatggtggatgtctccgccaaagcggaaaccgtgcgtgaagcgcgggcggaagcctttgtcaccatgcgcagcgagacgctggcgatgattattgatggtcgccaccacaaaggcgacgtatttgccactgcgcgtattgccggtattcaggcggcaaaacgcacctgggatctgatcccgctctgtcatccgctgatgctcagcaaagttgaagtcaatttacaggccgagccggagcacaatcgggtgcgtatagaaaccttatgccgcctgaccgggaaaaccggtgtcgaaatggaagcattaaccgcggcctccgtggcggcgctgaccatttatgacatgtgcaaagcggtgcaaaaagatatggtgattggtccggtacgtttgctggcgaagagcggcggcaagtcgggtgactttaaggtggaagcggatgattaaagttctttttttcgcccaggtgcgcgagttggtgggaacagatgcaaccgaagtggctgcggatttcccaactgttgaagcgttacgccagcacatggctgcgcagagcgatcgctgggcgctggcgctggaagatggcaaattactggctgccgtcaaccagacgctggtgagttttgaccatccgctgactgacggcgacgaagtagctttcttcccgccggtaaccggaggttaagatggcagaaaccaaaattgttgttggtccgcagccgttcagcgtaggagaagagtacccgtggctggcggagcgtgacgaagacggtgcggtagtcacctttactggtaaggtgcgcaaccataacctgggcgacagcgtcaacgcattaaccctcgaacactatccggggatgactgaaaaagcactggcagaaattgttgatgaagcgcgtaaccgctggccgctggggcgcgtcactgtgattcaccgcatcggggaattatggccgggcgatgaaatcgtttttgtcggtgtcaccagtgcgcatcgcagcagtgcgtttgaagccgggcagtttattatggattatctcaaaacccgcgcaccgttctggaagcgcgaagccacgccggaaggcgaccgctgggttgaagctcgggagagcgatcagcaggcggcaaaacgctggtagttttttgttagccggataaggcaccgctgcgtccggcaatttcaccgctcagtacatacgtttacgctgcgtcgatgcacagcctcatcattttgcagtatccttaagatattccttatatcttcaggagatcgtcatggacagattcccacgttctgattcaatcgtacaaccccgggctggcttgcaaacttatatggctcaagtctatggctggatgaccgttggcttgttgctgaccgcatttgttgcctggtatgcggctaattccgcggccgtgatggagctgttgttcactaaccgtgtctttttaatcggtctgatcatcgcgcaattagcattggttattgtgttatcagcgatgattcaaaagctgagcgcaggtgtaacgacgatgctctttatgctttattcggcgctgacgggtcttacgctttccagtatattcattgtctataccgctgcttctatcgccagtactttcgtcgttactgccgggatgttcggcgcaatgagcctgtacggttacaccacgaagcgcgatttaagtggctttggcaatatgctgtttatggcgttaatcggcattgtgctggcatcgctggtcaacttctggttgaaaagcgaagcattgatgtgggcagttacctacatcggcgtgattgtctttgtcggattgacggcgtatgacacgcagaaactgaaaaatatgggtgagcagattgatacccgcgacacgtcgaacctgcgcaaatattccattcttggcgcgttaaccttgtatctggacttcatcaacctgttcctgatgttgttgcggatcttcggcaaccgccgttaattctttttcaccatcactatcccggccatgtgtcgggatttttttcttactaaaaacgacacttaacaagtaccaggtataaaatatgccttatggacgagcggaagcgttttctgtatccataaatgcaaaagtattttgtatgcgtggttttaaatttattgatggtgaatattaatattttttctaaggataactaaaagaatggaatcatactcgcaaaacagcaataaattagattttcagcacgaggccaggatattaaacggtatatggctcattaccgctttaggtttggtggcaaccgcaggactagcctggggagctaagtatatcgaaattacggcaaccaaatatgattcaccaccaatgtatgtcgccatagggttattattactttgtatgtatggcttaagtaaggatatcaacaagataaatgccgccatcgcgggcgtaatatatctgtttttactctctttggtggcgattgtcgttgcaagtttagttcctgtatatgccattatcatcgtgttcagcactgcgggcgcgatgtttttaatcagtatgctggccggtttattatttaatgttgatcctggttctcaccgttttatcattatgatgacgttgacagggttggccctggtaatcatcgtgaatgcggcattaatgagtgaacggcccatttggataataagttgcttaatgattgtgttatggtcaggcattatctcgcatggacgaaataagctccttgaattggcggggaaatgccatagtgaagagttgtggagtccggttcgttgcgcttttacaggtgcattaacactctattactattttatcggcttctttgggatacttgccgcgatagctataacgcttgtctggcaaaggcatacgcgtttttttcattagccgtaaatgcacatactaaagaacttaactaaacttcacatcgccgcttcatttttcgcccgtagcttcttcgcctggctttccagcaacaggtaacagatcagcgccagcagcagtgggataaagtaatacagcacacggtaagcgagtagggcggcgataattgtacctttggaggtatgctccccagccagtagtgcgataaacaccgcttccagcacaccgatccccgccggaatatgcacgatgacgccagcaatactactaaccagtaacacgcccagtacaaagaaatagttcacgctttgaccaagtaacagccagataatcgcccccattaccatccagttaacgctggaaatcagcatctgagcgagggcgaatttccatgaaggcagcaccagcttttgccctttgatggtcatatggcggtgcttcgcgaaagcgcaaaaccacaaataaaccgcgataatcatcagtaagccaatgccgagaatacgcagcgtagtttgatcgacataccagtgatccggcaactccaccacgcctgcggtaaagataatccctgccagtaaaatgtagcccagccagttggtggtaatactgagcgagaaaatccgcgtaatagtgctaccgggcaaccccagacgagagtacaaacgatagcgcataccaatgccgccgacccaggtactgagcgtcaggttgaaggcgtagcagataaacgacaccagcatcacctggcgcttcgccagtttgtgaccgcagtaaaagcgggcgagcaggtcatagcagccgtaaatcagatagctgacgaccaccagcccgaccgcactaagcagcgcaacgcgattgtagtcgcggatgaccttccagacctcttcccagtccacttttttggcgtagaccaccagcaacacaatcaccgcgataaaaaacagccaggtgaggatcttctttgctaagcgccagcgcgggtgtgatttactcatcagggttttacccccgtgttttcagtttctacccgatcctgcgtttccattgtcggttgtgcgggcggatcaacctgcgccagacgtggcgtgtgtgccggaagccagccaaccagcgccgggaagtggcgtaaaaagtggaacgccagcacgcttttggtcaggttccaccaggtgcgtttgggcagcatggtttcatccacctgctgacaatctgcggcaataatgccgttcagattatcgcgcagcgtctggttaaaatgacgatcgtggatgatgacatttgcttcgagattcagtgacaaactgagcggatcgagattactggaccctactgtcgcccagtgatcgtccatcaatgccactttgccgtggagcgggcggcggcggtactcaaaaacctgaacgccgcctttaaccagatagttatacagcaagcgcgcaccgactctgacaatcggcatatccggttcgccctgaatgatcagtttgatccgcaccccgcgccgtgccgctttacgcaaggcgtgtaaaaatcgatagccggggaagaagtaggcgttggcgataatcacttcccgccgcgcctgagtgagcattttcaaataatggcgttcaatatcatcgcgatgttcttcgttatcgcgccagaccagcaatacctgcgcttctcccggctggcggttctcttccgctttgtgatgacgtcgccaccagcgtcgtgccgcgctctgtccaggcaggttttccagctcaaactggagaatatcttcgacaatcggcccttcaaggcgtaccgcgtaatcctgtttagcctctggaccgtagctggacatatgctcggcggagtaattcagcccgccaataaaggctatacgcgcgtcgatcaccacaattttgcgatgcatccggcgaaacacattggtgcgcataccaaaaaggcgagggcggggatcgtagtagcggaacactacgccagctgccgtcagttcattgacaaactcatcgctgagatccggcgaaccgtagccatccagcaagacttccgctttaaccccgcgttgcgctgctgccagtagtgccgcatgcagttgtttgccgacgtcatcctcaaaccagataaacgtttcaagaatgatgcgttcttgtgcctcgccaatcgccttaaacaccgcgggataatattgctcgccgttttccagcaactggatcttattgccttcgcgccagctacatttcataaatgaatctccgcacttaaaggggcatgatcagaaaggtgtcgccatgtccgcagcggcaacgcggttggcgcgctggcgctggcatttttgacgtagatcctgtccagtcgtagtagaggaaattgcaccggaaacgtgcgcgccgggcgtccgtgggcgcgggtaaaaatctcatccagtccggcctgcacttttaacggatgattagctttttgccgccagtcattgaaatcacccgccaccaataccggttcgccgtccggtagctcattcacccattcggcgagcatcgcaagctgcgcctgacggtgcgcctcacgcaggcccagatgtacgcacatcacatgaatcgcttttccggtcatcggcggcacaatgcggcagtagagcacgccgcgcttttccgcaccatcgaccgaaacatcgcgattctcataatgttcaatgggataacgcgacagtacggcgttgccgtgatgcccttccgggtatacggcattgcgaccgtaggcaaaatcgctccacatagtgtcggcgagaaactcgtagtgcgaggtatcgggccagttttccacatgcagcggatgaacttcgtgcgcgcccatcacttcctgcaggcaaacaatatcggcgctgacggtacgcacggcgtcgcgaagttccggcaaaatgaagcgtcggttaaacgcggtaaagcctttgtgaatattgatggtgagcaccttgaacgaaaattgttgtgtttgatcgggcataattttcctgtctttgcctcttatctcattgaaatagtgtagtcggcgtcacaaaaaggtgcggtcttacggaattttccgtaaagttcggtactctgagtaagtagagataaattcttcaggagagaagccatgaagtggcaacaacgtgttcgtgtcgcaacgggtctaagttgctggcagattatgttgcatttactggtagtggcgctgctggtggtgggctggatgagtaagactctggttcacgtcggcgtgggattatgcgcactgtattgtgtcacggtagtgatgatgctggtgtttcagcgccaccccgagcaacgctggcgtgaggtggcagacgtgctggaagagctgaccacgacctggtattttggcgcagcgctgattgtgctgtggctgttgtcccgcgttctggaaaacaactttttgctggcaattgcagggctggcaatccttgccggcccggcggtagtgtctttgctggcgaaagataagaagttacatcaccttacgtctaaacatcgcgtacgccgctgaccctgtcgtggccgttatcaccagtagcggccacaaactattccacacaatatccagactcgcatccttcaaataaatctgcttggtaatgtccgtaaagtggcgaatagggttaatccacgtcaggttttgcagccataccggcatgttttccaccggagaaacgtaaccggaaaggagaatggcgggcatcataaagacaaacacgccgataaacgcctgctgttgtgttgaacagagtgatgaaatcaacagaccgaatcccaccagcgataaaccataaatcaccatcgtaaagtagaacagcgccagcgatccggcgaaggggatttgatacgcccagataccaatcgccagcacaatggtggcctggaaggtggcgacaattaacgccggtacggctttgccgatgaagatctgccaggtggtgagcggcgaaaccagtagctgatcgagcgtaccttgttcacgttcgcgggcgacggaaagtgaagtgacgatcattacgccgatagtggtgatcatggcgatcagtgacggcaccacaaaccatttgtagtcgagattcgggttataccagttgcgtaccaccagctcgctgttgttaggtttcggttttccttccagcagctcctgctgataatttttgacgatctgttgcaggtagttggcggcaatttgcgcactgttggagttacgcccgtcgaggatcaactgcaaaggcgcggtctggaaggtatccagtttgcgcgagaagtcagccgggaaacgcaccagtagtaacgccttttgtgtgtcgatggttgggcggatctcctgtgggcttttcagcagcagcacatgagtaaaggcgctggcgcgggcaaaacgttgggtcagctccaccgaatgctcgccgttatcttcatcgtagatggcgatggtggcgttagtcacttccagcgtggcggcgaacgggaacaggatcacctgaattagcacgggtaaaatcagaatcgcgcgggtttgcggttcgcgcagcaacgactgcaactctttgcggattaacgtccataagcgatgaaacatgctcttctccctaatccagccgacgtttggttttcagccacgtcaggccgataaacatcaccgccgaagcgatcaaaaacagcacgtttaccaccagcaccactggaatattcccggcgaggaacaggctttgcagggtgctgacgaaataacgagcgggaataatgtacgtcaccgcgcggatcaccgcgggcatactgtcgatctgaaaaataaagccggaaagcataatcgacggcagaaaagcggcgttcagggcgacctgagcggcattgaactggttgcgggtaatcgtggaaatcagcagccccatccccagggtactgagtaaaaacaggctggagataaaaaacagaatcagcagcgacccgcgatacggcacgccgagaataaacactgacaccagcatacacagcaacatcgccagcatcccgagaaagtaataagggatcagcttacacagcagcagttccgtgcgggtaatctccgtagagagcagagcctccatggtgccgcgttcccattctcgcgccaccaccagcgaggtgagaatcgcgccgatgaccgtcatgataatggtcaccgcaccggggataatgaagtgctggctaatcgccgccgggttaaaccagtagcgggtttgtacatcaataagcggttcaaaagtctgcccgttgtcctccgctcgctgcatttgccagatctgccagatcccttcgacatacccctgtacaaagttagcggtattcggctcactgccgtcggtgatcacctgaatcggtgcggtggcgttggcgcgctccatctgttccgcaaaatccaccggaataaccaccagaccgcgaattttccccgcctgcattttggcgatcagttcctgacggttatcgctgatggtggcgtcgatgtagggcgaaccggtcatggtgtgggtgaaatccagcgccgcttcgctacgctgttccagtaaaatcccgacccgcagcttgctggagtcgaggttaatgccgtaaccaaaaataaacagcagtagcagcgggatcactaccgcaatcagccagctactcggatcgcgaacgatctgccgcgtctctttaacgcacagcgcccgtacgcgacgccaggacaggatcgggttactcattgctatgctccttatcccagtcgtggatcaactgaataaaggcttgctccatggtgggatcgggttgctcatcgttagccgactgtgctttcaaatcgtccggcgtgccgctggcgattaatttcccgcggtacaccaggccgatgcggtcgcaatattccgcttcatccataaagtgggtggtgaccatcaccgtgacgcctttctctaccatgctgttgatgtgcagccaaaattcacggcgggtgagggggtcaacgccggaagtcggttcgtcgagaaacagaatgtccggttcatgcatcagcgaacaggccagcgccagccgctgtttaaaacctaatggcagttcatcggtggcgtgggaggcgatacttttcaggccgaacgcctcgctcatgcgggagattttttcgttctgcgcccgaccgcgtaagccatacacaccagagaaaaagcgtaaattctgttcgaccgtcaggttaccgtagagcgaaaatttttgcgccatatagccgagatgctggcgcgctttaccggaactctctttcagatccatccccagcaccagcgcctggccggaagtcggcaccagcaaaccgcacatcatcttaaaggtggtcgatttacccgcgccgtttggccccagcaaaccaaaaatctccccacgtttaacggcaaagttgacgtgatcggtggcggcaaaatccccaaatttcttggtcagttctttcgcttcgatcaccgtctcgccgggtgtgccttctaccgtatgtaatattgcgcccagcggcgattccgaggttccggcaccgcccagcaaatcaataaacgcatcttcaaaacgcggcgtagtttcgttgatgttgatttccggcatcccgtcggcatggcgaatatcgtctggtgtggcctcttttttgaggatcagacgtaccgatttcccctgaatcatgccgtcgctgacctgcggcagtttcaaggcgcgttgcaacagtttgcggttgccctcgtgtggactggtcatcagaaagctgcgtccggccatggtttgtgtcagggcttttggttctccctgatacagcaactcgccttcgttcatcagtaacacgtcacggcactgctcggcttcgtcgagatacgaggtactccagaggattaacatcccttcgcccgccagctcatgcaccatctgccacagttcgcgccgtgagatagggtcaacgccgacgccgggttcatcgagcagcaacactttcggttcgcccaccagggtacaggccagaccgagtttttgtttcatcccaccggagagcttgcccgccaggcgtccggtaaacggcccaagagacgtaaactccagcaggcgagcaaaagtttgcttacgtgcctcgccggtgacgctgcgcaaatccgcgtacagattgaggttctccatcaccgtgagatcttcatacagaccaaatttctgcggcatataaccgagcacggcgtgcagcgcgccgtcgtttttgatcggatcaaagccaatcaccgtggcactgccgctgtcgggtttcagtaatcccgccaacatccgcatcagcgtggttttacctgcaccgtccggccccaccaaccccgtcacataaccggcgtgaatggtacaatcgagcggcgcgacggcgggcttgtccatgcccggaaagcgtttttccaggccgttcagcgtgataacggcatcattcatgtcctgcctcgtcaccgaattgtaccgtcactggcattccctggcgtaacgcatcatcggcgtcggtcaccacaatacgcaggcgatagacgaggtcggtacgcagatccggcgtttcgacggttttcggggtaaattcagcagtcggcgaaacgaaaccaatctgcccgtgatacggcttgtccgggcgaccatcggtataaagcagcactttgcgccccggctgggcctggtcaagattacgttcatcaacataagcgcgcacccacaccggacgcgttagtgaaacggtaaacaccgtgccaccttcattgaggaccgtgcctggctccaccgcgcgcgttaacagcgtgccatcagacggggctatcaacgttgagtcctgtaaattcaactccgcctgcgccagttgcgcctgcgcctgttcgaggctggctttcgcctgagcgatgtcctgttcacggttaccggaacggtactgacgcaatttatcctgtgctgatttcagcgttgcctgcgcctggtcgcgcgaggagcgggcattttccaggtcatttgccgaaatagtgcggcttttccacaacccttgctggcggttatagaagttctgcgcatagtcataggcggcttgcgcctgtttcaccgctgcggcggcctgagcgatttcttcattgcgatacccggcaagcatcaggtcatactgcgcctgtgccaccgaaacacccgctttcgcctgcatcagggcaatctcatacggcttgtgatccagttcgcccagcacctggcccgctttgatagcatcaccttcgtccaccgccagcgattcaacgcgccccccaacacggaaactaagatttaccgtacgaatatccacgttgccatacagcgtcaggccgttatcctggcggctttgataccaccagtagcctccggcaaccacggcggcaagtaccactaccgccaatccgatcacgacaggttttttcatcactacaaactcctttgcgataatccttgcaaaatcaggtcgatatgacaggtcaccgtctggttgatcagttcggtcttttcttcatcgaacgcggtccagccggtacgtaacagaattgtttctttgccaagacggaacgccagaatctcaccaatcaacgcatgggtatgaaggatcatgcgggtgtcattggcgtcgcagccggtccaggcggcaatcaggcgtgtcaggtggctgtgtagcggactaatcacctgttcgtgcaccaggtggtaggctgccgtgggagagagctgctcacgggagataaacttgctgaggttgacggtgtcatcctgggtgagcagcttaatcatgttcctgcaggcgcgaaggatcagttcacggatggcagcccgatcaggctgtggttgcgcgaacaagcgttcggcttcctcggcatgcggacggaactgctcgccaataaaatcggcaatccactgggcgcaggcgaggtacaaatcttctttcgaaccgaagtagtaggtgatggcagcgatattctgcccggcctgggcggctatctcgcgagtggtggcgttcattccatattcaccaaactgcgccagtgcggcagcaatcagctgttttttcgcctgttcacccttgattgtcatggcaggattattcatcgcacagtccattcttaatcaaatgattgattaagattatgactccataggggagttgtccagtatggctaagaattttagcaacgccagtcacagggataatttatgcgctgcgtcacaaaaactgctacactccgctccctcatgacattgtggtttttgtcattttccttttcagtatctccctgaaaactacaccggtaacggtcggggcggttcggagtagttatgtctttcgattctttgggtttaagccctgatatcctgcgcgccgttgccgagcagggttaccgtgaacccacccctattcagcagcaggcgatccctgcggtgctggaaggccgcgacctgatggctagcgcccagaccggcaccggcaaaacagcgggctttacgctgccgctgttgcaacacctgatcactcgccagccgcacgccaaagggcgtcgtccggtacgtgcgctcattcttaccccgacccgtgaactggcggcgcagattggcgaaaacgtccgtgattacagcaaatacctgaacattcgttcgctggtggtgtttggtggtgtgagtattaacccgcagatgatgaaactgcgtggcggcgttgatgtgctggtggcaaccccgggacgtttgctggacctggaacatcagaatgcagtgaagctggatcaggttgaaatcctcgtcctcgatgaagctgaccgcatgctcgacatgggctttatccacgatatccgtcgcgtgttaacaaaactacctgcgaagcgccagaacctgttattctccgcgaccttctctgacgatattaaagccctggcggaaaaactgttgcacaacccgctggaaatcgaagtggcacgccgcaataccgcgtctgatcaggtgacccagcacgttcactttgtcgataagaaacgcaaacgcgaattgctgtcgcacatgattgggaaagggaactggcagcaggtgctggtgtttacccgtaccaaacacggcgctaaccatctggctgaacagctcaataaagatggcatccgtagtgcggcgatccacggcaataaatcgcaaggtgcgcgtactcgtgcgctggctgattttaaatcgggcgatattcgtgtactggtggcaactgacatcgctgcgcgcggcctggatattgaagagctgccgcacgtcgtcaactatgaactgccaaacgtacctgaagattatgtccaccgtatcgggcgtaccggtcgtgcggctgctaccggtgaagcgttgtcgctggtgtgtgttgatgaacacaaactgctgcgtgatatcgaaaaactgctgaaaaaagagatcccgcgcattgcgattccgggctatgagccggacccgtcaatcaaagccgaaccgatccagaacggtcgccagcaacgtggcggcggcggtcgtgggcaaggtggtggtcgcggtcaacagcaaccacgccgtggggaaggtggcgcaaaatctgcaagcgcgaaacctgcagaaaaaccgtctcgccgcctcggcgatgccaaaccggcaggcgaacaacaacgtcgccgccgtccgcgtaaacctgccgctgcgcagtaatcttttatgccgggctatgcccggcatcaggctgatgaacaaacgcaaaactgcctgatgcgctacgcttatcaggcctacgtgaactctgcaatatattgaatttgcatgcttttgtaggccggataaggcgtttacgccgcatccggcatttcacaacaagcacttgtcagcaatttgagaacacgggaaaaaatttatctgttttaccgcccataagccaccgagacgttacttctctatagccaattgttcgcgcaactccattaaaaggtagcccagtcgattcttgcccttaccatgaccaccgtctccccagtaagcatcgttttccgtatgctcaaccagttttgcgggcgcggttgccagcaagagcgcacgcagttctgcatgctgttcgaatttagcgcgaagtgcttttcgcatcacctgttctttgaccgactcccagtttttacgcagaggcttagaacgatcgcgccccatgcgtgcggcgaccataggggaagaaacccgacggatctcttcgcggtatttttcatcaaggaatttttgtgcctgaaaatagtgttctgaggtaggccaggttttcccgtcaaccttgatgggccaggcggcaaagttagaaaaatcaccgtagtcatcgctggtgctgtagaaatttatgatggtgtcttgcatgacgtgttggatcctttgtgctcgaacgggcattaaaccgcattatgttggtggttattgcgagccgctttccagaaacagaaaaaccattacccctgaaaaccgaaaaatgccacaatattggctgtttatacagtatttcaggttttctcatggcattaaccgccgcgcttaaagcgcaaattgccgcctggtataaggcgcttcaggaacagatccccgactttattccccgtgcgccgcagcggcagatgattgcggacgtcgccaaaacgctggccggagaagaagggcgacatctggcgattgaagcccccaccggcgttgggaaaacgctctcttatttgattcccggcatcgccattgcccgcgaagagcaaaaaacgctggtggtgagtaccgccaacgtggcattgcaggatcagatttacagcaaagatttaccgctgctgaaaaagatcattcccgatcttaaattcactgccgcttttgggcgtgggcgctacgtttgtccgcgtaatctgacggcgctcgccagtactgaacccacgcaacaggatctgctggcgtttcttgacgacgaactgacgccgaacaatcaggaagagcaaaaacgttgtgcgaagctgaagggcgatctcgatacttataaatgggatggtctgcgcgatcatactgatatcgctatagatgacgatctctggcgtcgtttaagtaccgacaaagccagctgcctcaaccgcaattgttactactatcgtgaatgcccgttttttgtcgctcgtcgggagattcaggaagcggaagtggtggtggcaaaccatgcgctggtgatggcggcgatggaaagcgaagcggtattgcctgacccgaaaaatttactgctggtgctggacgaaggccatcacctgccggatgtggcgcgggatgcgcttgagatgagcgccgaaatcaccgcgccgtggtatcggctacagctggacttgttcacgaaactggtcgctacctgcatggagcagtttcgcccgaagaccatcccaccgctggcgatccctgaacgtttgaatgcgcattgtgaagagttgtatgagcttatcgcctcgttaaacaacattctcaatctctacatgcctgccgggcaggaggcagagcaccgttttgcgatgggcgaactgccagatgaagtgctggagatctgccagcggctggcaaaactcaccgagatgctgcgtggcctggcggagttatttcttaacgatttaagtgagaaaaccggcagccatgacattgtacgtctgcatcggttgattttgcagatgaaccgcgcgttggggatgttcgaggcgcaaagcaaactctggcggctggcttcgctggcgcaatcttccggtgcaccggtgaccaaatgggcgacgcgggaagagcgcgaagggcagctacacctctggtttcactgcgtgggaatacgtgtcagcgatcagctggaaaggctgctgtggcgcagtattccgcacattattgtcacctccgcaaccttgcgttcgctgaacagtttttcgcgtttgcaggagatgagtggtctgaaagagaaagcgggcgaccgttttgtggcgctggattccccctttaaccactgcgaacagggcaaaattgttattccccggatgcgcgttgagccttccatcgacaacgaagagcagcatattgccgaaatggcggcctttttccgtaagcaggtggagagcaaaaaacatctcggtatgttggtactgtttgccagcggacgggcgatgcagcgctttctcgactatgtgacggatttacgtctgatgttgctggttcagggcgatcagccgcgttaccgtttagttgaactgcaccgcaaacgcgtcgccaacggtgagcgcagcgtgctggtgggcttacagtcatttgccgaagggcttgatttgaaaggtgatctgctcagccaggtgcatatccacaaaatcgcttttccgcccatcgacagcccggtggtgatcaccgaaggggaatggctgaaaagcctcaaccgctatccgtttgaggtgcaaagcctgccgagcgcctcgtttaacctgattcagcaggttgggcgactgattcgaagccacggttgctggggcgaagtggttatctacgacaaacgcttgctgaccaaaaattatggcaagcgactactggatgcattaccggtatttccgatagagcaaccggaagtccctgaaggtatagttaaaaagaaagaaaaaacgaaatccccacgccgtcggcggcgttaatgatgtgagtcaggtaaggagtcgtaaatggactatcgcaaaatcattaaagagatcgggcgcgggaaaaaccacgcgcgcgatttagaccgggatactgcgcgcggtctgtatgctcatatgctcaatggtgaagtccctgaccttgagttgggcggcgtattgattgcgctgcgtatcaaaggagaaggggaagcagagatgctcggcttttacgaagccatgcaaaatcacaccatcaagctgacgccgccagcaggcaagccgatgccgattgtcatccccagttacaacggcgcgcgtaaacaggccaacctgacgccgttgttggcgattctcctgcacaaactcggttttcctgtggtggttcacggggttagcgaagatccaacccgcgtgctgactgaaaccatttttgaattgatgggtattacgccaacgttgcacggcgggcaggcgcaggcgaagctcgacgaacatcaaccggtgtttatgccagtcggcgcgttttgcccgccgctggaaaaacaactggcgatgcgctggcggatgggcgtgcgtaacagtgcacataccctggcgaaactggcgacgccatttgccgaaggtgaggcgctgcgtctttccagcgtttcgcatccggaatacattggacgcgtcgcgaagttctttagcgatatcggcgggcgggcgctactaatgcatggtactgaaggtgaagtgtatgctaatccgcagcgctgcccgcagatcaatctcattgaccgtgaagggatgcgggtgctgtatgaaaaacaggacactgctggtagcgagttactgccacaagcaaaagatccggaaaccacggcgcagtggattgagcgttgccttgctggcagcgaaccgattcccgaatcgctgaaaatccagatggcttgctgcctggtggctacgggtgaagcggcaactatcagcgacggcctggcgcgcgttaatcaggcattttaattcttttctcagccggatgagccatgtcatccggcttttaccccaccgcaatatgaaattcctgcatctttattgaccttcccacgcccggcgtgcagcataaaaatacaacaaacacataacataaacaggagttaaccatggaaagtggtcatcgctttgatgctcagacgctgcacagttttattcaggctgtatttcgtcagatgggtagcgaggaacaagaagcgaaattagttgccgatcatttaatcgcggcaaacctggcagggcatgattcacatggtattggcatgatcccaagctatgtacgctcctggagtcaggggcacctgcaaattaaccatcatgccaaaaccgttaaagaggcgggggcggcggtcacgctcgatggcgatcgcgcatttggtcaggtcgcggcacatgaagcgatggcgctggggattgagaaagcgcatcagcacggtattgccgccgtggcgctacataactcgcatcatatcggccgtatcggttactgggcggagcagtgtgcagcggcggggtttgtctctatccactttgttagcgtggtcggtattccaatggtcgcgccgttccacggtcgcgacagccgctttggcaccaatccgttctgtgtggttttccctcgtaaagataatttcccgctgttgcttgattacgccaccagcgccattgcatttggcaaaacccgcgtcgcctggcataaaggcgtccccgtgccgccaggttgcctgattgacgttaacggcgtgccgacgaccaatccggcggtaatgcaggagtcgccgttgggttcgctgttgacctttgccgaacataaaggctacgcccttgcagcgatgtgtgaaattcttggcggggcgctttccggcggtaaaacgacgcatcaggaaacgttacaaaccagtcccgatgccattcttaactgcatgaccactatcatcatcaacccggaactcttcggcgcgccggattgtaacgcgcagaccgaagcctttgccgagtgggtgaaagcctcgccgcatgatgatgataagccgattttgctaccgggcgagtgggaagtgaacacgcgtcgcgaacggcagaagcaggggattccactggatgcgggaagctggcaggccatttgtgatgcagcgcggcagattggtatgccggaagagacgttgcaggctttctgtcagcagttagccagctaaaaaaaagcccgtccagtggcggacgggcaaacaagggtaacataggatcaatgagggttagagcatatgcgtctgtcggcaaacagacagggaaatacttgtgctggacgtagcgtaaacgcctgatccgtccaacggttcggattttgtaggcctgataagacgcggtagcgtcgcatcaggcatctgttgccggatgcggcgtaaacgccttatccgtcctacgaattacttataaattaccgcagtaccgcttaatttattgttgttggtggcggaagtgatgctgtatccactggcaccggctgccgcggctttctcagccagtttcgcttccagggcatcgagggtggatgcgccatcggcagaaaccacgccgattttattcatgttctgtgcctgggatgccgttaccggttccgccgcgaacacgccaaatgacagagttgaaagagccatagcagcaacaacagtattgatagttttcataattaatctctcgcaggtgatttttgtataagtgacgttgtttcgtcgatgtgatgagtatcacgtttttttacgagagataaaatcgaagagaattgaccgccttgttcaaataaattgattgatatctaacctactgataaaccatttatttgttgtacttatgaacttgttttataccgcgtggcagtcacagcagcgttaaaggcacggaatgacacgcaaaatacaaattatactcgctatgcatctcgccagttgtagttaacgtaactggctgtctttcgaacctctgcgattatatcctgtataagctggtttttgtaaatctttctcctgctgacaatgaatacataagcgcacgccaggaatggcttcccgacgggcctgcgggatgggggcaccgcactcttcacattcatccaggctttcgccgcgcggaatttcaccccgagcgcgggcaatcgcatcttcaattgtactgttgatctgttcgttgacggcgtcatcgttagcccaaccggatgccatatcgacctccccatatcaatacttgtacagttaagtgtagctaatccagggacgaactcgggcagttcaagcatcagatctccgaccattcccgcagcagattatgataaagattaagcagcgacaggatctcttcactttcgccgtagcggcttttcagcgactgaatattgttgtccagttcaaacagcatggcgcgctttttatcatcgcggatcatcgactggatccacataaatgatgccactcgtacgccgcgggttacgggtgtcacgcaatgcaggctgctggagggatacaacacgagatcgcctgccgggagttttacccgatgttgtccgaaggtgtcattaacgaccagttcgccgccgtcgtagctttgtggatcgcttaaaaacagcgtggcagaaaggtcagtacgcatccagccgttttgtggatggctgcgtactgcgccatccacatggaaaccataggtttcattgttctgatagcgattaaacagcggcgtggaaagggtacgcggcaaggccgcggcaaagaataaagcatgttggttaaccgcgttcagcacctcattttgcagggcggcgtataacgtgctgcgggtgtcgacctgttgattgttcttaacttgcgcaccttgtgcgccggtggtgacgcgtccatccacccattcggcttgttccagttgttcgcgaaaacgagcgacgtcctgtggcgataacacgccgggaatgtggtacatcatacaatttctccaaaaagtggggcctgcgccccacatctgaatcagaaatgcatattggctgtgagcaagaaggttcttggctcgcccgggtgataacggtagccgctcttgttgattgaggcgacgtaatcggtatcaaacaggttgtaaacgtttagctggaagtcgagattgcgattaactcgataccccagtttggcatcggcgacccagtaaccttcggtaaacgctggcgttcccaccgcgccgtctgaacctttatgcatactgccgatatagcgtgcgcccgcgccaacagagatatcgtcggttgcctgatattggctccataaggtgaaggcgtgctccggggtatacggcagcgatgaggaaccatcctgggcaacatctttgccgtttttgatggttgctttttgctgggtatagccgccaatcacctgccacgcgggagtgatattcccggccacggatatctcatagccttcgacgcgtttcttaccgtattgcgagtaagttccgtcatcattttgctcaacttcattttcgatatcagtgcggaacagcgcggcggtgagcaacagacgtttatccagaacctgccatttggtgccaatctcgctggtgttggctttttgcggtttaaaatcggtgcggttggcactgttaccgctgccagactgcgcaagggcgaagttgttgccgcccggaggctgctgggaaacggcatagttaatatagacattgccgttttccgtcaggtgatacagcgccccggctttccagttcatcagattgcccgacttggcggtgtcgacggtggtgaccggagaaccttttgccacaccagttgggcaggtgatggcaccgcgtccgctgccgccgcaggcggtggcactgtcatattcagtatgataattatccagacggatcccgccgttcagctcaaaatcacgggtgatttgcagcgtatcaaaggcgtaaattgcgaaggtatccgtctgaccattggcgtttgcgccgttgcgcgtcaggccgccgggatgaatgctgctgtcaggatgataaatatttaccgcgggtaacgtcaccggattaacgccgtagttagtctgcgtttcacgggtaaattccacgccggtactgacatcatgaccgatagaaccggtatagaacgtcgaggtcaggttggtctggttggtgagaattttattactcacatctttggtattcgccgtgcgtgaccaggtccagctattcacatcgctggtgggctgagtaatattcgacgccccgcccataatcgccgtcatcaggtaatcctgctttacgcgcgaccaacgggtagtattgcgaatggtggtgttatcgttgatgtcgtgctcaaaacgcatggtggcggtgtcggtggtcgaatcgtcgtaatcggaatccgtgccgtaaaagttatgagtatcaacttttccggaatgattcagggccgccgttcccgcagatggggcagaatagcccggcaaaccgatggtcggaatgccgccgtctggcgtgttgtgctgggtgacatgcagataattaagatacaaacgattcgctgtaccaaggccaaaagcgacagaaggggcgacgccgtaacgctcatttttgactttgtcgcgtccggcatcgtgcgttttttcgcccattacattcaggcgcaccgcggtggtatcaccaatgacctgattgacgtccagcgtgccgcggcggaaccaggcgctgccaatactggcggaggcgtcaatgccggaatcattgcgcggctgcttgctgatcatattgatcgagcctgtcggtgcgctgcgcccgtagtcggtgccggacggccctttaatcacttcgacctgctcggtattgaaggtgtcgcgcgagacgctgccgatatcgcgaatgccatcaatataaatactgttagaggtatcggcaccacgcatataaatggcgtcgccagtggtggagttaccgttctcacccgcaaaaaacgcacccacgccggggacgtttttgagcgcgtcggtaaggttggttgcgccctgatctttaatcacttgttcagaaattaccgtcatcgtgcgggtagtatccgctaccggacgcgagaatttcggatcggcagattgttgtggcgcataaagcgaaggcgttgatgcttcgacaaccagcgtgtcatccgcgttagtttgcccttcggcggcgagtgcctgagccacaggcgtgatgccaatacaaagaccggcaaagaacgtgagcgaatgaaattgtctggcagggaaattgcgattgttttccattttgcaggtgactttttcttatatgttgaaattttcactgccacgagaaagcctctctgcggatgcgatgccactgttaatcccgtgatagtgctcgtgaaagtgataataattttgataagcattatcacttggagcgattttctatcacccattgcgcgaaaaagaaatacatttatttacattgagttcatatttgatgttttttgattacaaaacagacgaaaactgcatccagaggcgaatgcagttacgttggtggggttatttgtagatggttgcagtaccgaacatctggtcatttccgcctgcggaattaatgacataacctttcgcgccttgttcgcgcgctttttctgccagtttatcctccagatcgcttaggtttgatgcgccagttgccgaaacggtaccggcgggccgtagctgaccgctgtccaggttactcatcggttgcgcggcataagccgtgagagagattccgctcaggacggtggcaatcagtagtgtgaggcactttttcataatgacatcctcataaatacaacgggtagtgcctgataagtgtaggtcgcctgcgcgatgcaaatgacgcaaaaaattgacagagatgtgcttattttttgaacgatatatttttacaaaataagacaaatcaatgacatgcataatgctgatttttatgatgaattgccataaaccatagccatgttaaggttttggggaatgataaacgcagccagatatttaccctgtcgcgttatgcgggtatcttacgccgctgcttaaaggagaatgctatgtccgcccagaaaccggggttgcatccgcgcaaccgtcatcacagccgctacgatctcgccacgctttgtcaggtcaatcctgaactcaggcaattcctcacgcttacacccgccggggagcaaagcgtagactttgccaatccgctggcggtgaaggcgctcaataaggcgttgctggcccatttttacgccgtagcgaactgggatatccccgacggttttctctgcccaccagtaccgggccgggcggattatattcatcaccttgccgatttactggcagaagcaagcggaacaattccagcgaatgccagcattctggatatcggcgttggtgcgaactgtatttatccgctgattggcgtacatgaatatggctggcgttttaccggtagtgaaaccagcagccaggcgttaagcagtgcgcaggcgattatcagttctaatccggggcttaaccgcgccattcgtctgcgtcggcaaaaagagagtggggcgatttttaacggcatcatccataaaaacgagcaatacgacgcgaccttgtgtaacccgccattccacgattccgccgctgcggcacgggcaggtagtgagcgtaaacgccgtaacctggggctgaacaaagacgatgcactgaactttggcggccagcaacaggagttgtggtgtgaaggcggtgaagtcacctttatcaaaaagatgattgaagagagcaaaggcttcgcgaagcaggtgatgtggtttacatcactggtatctcgtggtgaaaacttaccgccgttgtatcgtgccctgacggacgtgggcgcggtgaaggtggttaaaaaagagatggcccaggggcaaaagcagagtcgctttattgcctggacctttatgaacgacgagcagcgccgccgttttgtcaatcgccagcgttaaagcgttggttcccccggcggtaacggttcagccggggtcgcgcccggagcaggcagcacctgataagtctgcactggcgcgcgaacgcccgccaggtcgaaatgttttttcacctggctgtcgagggcaaagcgtaccgtccactgtttgagtggcagcgtggtgaacgaaacacgcagtgtaaacgcggtattgcttaagccgacaatcccggcaaaattcggttcaccaataatcagcccgcgaatttcttcgttttccattaattccgctaccgcatctttcagtgcctgattggctttatcagcatcttcatggcgatcaacatcataatttgccaccaccgaaccaatgccgcggacaaagttagcaaaggtggttatcgaagaccacggaatgatgtgatacgccccggtatcctgtcgtacgcccacggagcgaatcgacatccgttccactgtgccggtcaacggcccgatagtcaccaaatctccagtgttcatgccgttttcaaactgaataaataccccggtgataatatctttcaccagcgtttgcgaaccaaacgagatagccagacctaatgccccggcacctgccagcaatggcgcgatattgacgccgatttccgacaacacaatcatgatggtgatggtactgataatcaccgccagcgcgttacgaaacagcgtaagcagggtacgcgtgcgggcgctgggtagcgggcggccatgaatatccgaagccagccggttttcgatcaaactggcgagcaccgtccagccaaccgccgagaagaaaagaatgagtgcgatacggatcaggatatctacggttttctgccccgcgccgttttgcagccagttccagaaatcgaacaatccccatgcgctcaacagcaacattaccgccacgcagactgtcagaatacgcgccgttttcagcgccgccgacagccagccattcaaccgtttttgcagctccggatagttacgctgagtatgtggcgagagagtgatggttttcgccagccagcgggaaaacataccggaaacaaacgctgcgataccaataatcgccaggctgcgcaccgttgcacccatcataaatttcaggctgttgcccggatcgaacaacgaaaagaaaaacagcacgataaaataggcgcttgccagccagtgccacaccagcgcaaaggcgcggataaacaggctgaaaaaggccagcgaatgctccgcgaagttgagcaaatgctgggtaatctcttttttattacgaaagatcaggtacaacgcccagacggtcatgcacagcataatgatgacgttcgccagcgcacctatctgtacattcacctgattagagataatcggcacggccacaatcaggccataacctatcaaactgcttaaccagctcaggcgacgactccagtaacgggcgctctcgtcctgaatcgtgaacgggcgcagctccgccacgtttgggcaaaaaatcaggcgtagtacggctttgaaaaattcaatgagggcaaaggcgttgagaaacaaactttgttggaaagcgatggtgcgactgcctgcattcaggttgtcgcttaatacctggccgacaaataatgtcagggccagtaacagcaggtcgataataaacgccccgataatcatcgccggaagctgcaaccagttgctgcgctcacgatttttttgccgcgcccactgacccattttgcgatacagcggcagtgcgcacaggcgaatcagccagtaaaaaccaaacactaataccgctaacattgaaaaatgggtcagcgcattgctgaaggtttgtggattaaacggcttatgcggggagccggtgatattgcgataaagttgcccgaagcgggcggaaagggcttcaccataatggcggctgacttcggtgaccttttgcagcacggtttgctcttcgaccagcgtcggcggcactatttttggtaccggttcagcagggggcgtagcggcaacggtgcgcaactggtcgatcaactctttacgcgaggtgtcattatccagcacatccgccagtgcgccataggccgcttttttttgttcgatatccggttccggggccggttcagtcgttgagtccgttgtcgttgtggttgtaacgccgggtatggataccgcgtgggcaggtgcgcccagcaggcagaagaggatgaacaggatccaccgcatgactcctccagtgagaaaatagagcaaaaagataagtatagatgctggaggaggggcgattttaaatgagaggaatctggtgtgcctccctttcgggtgaaagggaggaagggatattaagcaggttgctgacaacgtgcgggcttttttgccggatgcggcgtgaacgccttatccgtcctacaagttcatgcaattttaataagttgccagatatcctgtaggcctgataagcgtagcgcatcaggcaatgtgtcttattaagagacgtgctgcaaaaattcctgcaagcgctggctcggcgggttcttgatcaacacctgcggattgccatcttccgcaatccggcctttgtcgataaagatcagccgcgaagctactttctcggcaaaaccgatttcgtgggtcacgatcaccatcgtcatcccttcttcagccagatcctgcataaccttcagcacttcatggcgcagttccgggtcaagagcggaagtcggttcatcaaacagcatcattttcggcttcaccgccagcgcgcgggcaatcgccacacgctgctgttgaccaccagaaagttcggaagggtagtgatgtgcacgttctgccagaccgactttcgccagcagctcacgtgccagtttttccgcctcttctttgttcgcgccacgcacgcgtagcgggccaaacatgacgttttccagcgctgtcagatgcgggaagaggtaaaactgctggaacaccatacctgcttcctggcgaatcaggcgctcgtcaactttcggatcgttaaccttcaggccatcgacaatcagatcgccggaggtgatttcttccagtttgttgatgcagcgcagcagggtcgatttaccggaaccggacggcccgataatcaccacgacttcgccctgggcaatgttcaaatcgatattgtgcagcacctgggttgggccaaagtgcttggagacgtttttaaattcaatcacaggattttcatccttctttccagacgacgcagaataaagctcagcaccagggtaataatcagatagaacaccgccacggcgctccagatctcaagggcgcggaagttaccggcaataatttcttgcccctgacgggtcagttccgccacgccgatcacaataaacagcgaggtgtctttaatgctgatgatccactggttacccagcggcggcagcatacgacgcagtgccagcggtaaaatgacgtagcgaatggtttcccaacgtgaaagaccgagcgccagtcctgcttcacgaaaacctttgtggatagacagcaccgcaccacgcgtgatttccgcaatatacgcgccggagttgatcatgatggtgaccaccgccgcagtaaatgggtcgatgcgtaagtcgttaaacgccatcggcagggcgaaataaataaacatcacctggacgacgataggtgtgccgcggatcacttcaataaagaccagcgcgacgtggttggctatccaacctccgaaggtgcgtgcaaaacctgccagcaatccgattaccagaccgcctgccagaccgaggaccgaaatccacagggtcattttggcaccttcaatcagaagcggaatggcaggccagatggcactccagtcaaactgcatatgttgttcctgttaccgtggtgtaaataatcaaattcagggtaattaatggccccggagcgggtttgcgcccctcaccctaatcctctccccataggggagagggaactgccagtgcgttttacaggtgtagcgttattatttcggttcagtaccgaaccattttttgtagatttcgttgtaagttccgttctcgcgcagggttttcaacgcgccgttgactttgtcacgcagctcgtcgctacctttcgggaacgcaataccgtattgctgcgcttccagagagtcacctaccgctttgaactgaccgttaccggcggttttgatgaagtacagaatgtttggcgtatcgtgcagaacggcgtctgcgcggttggtgcccagttccatataggcgttatcgatgttcgggaactgacgcagatctttagttttgatgtttgctttcgcgtaatcaacggagccagtaccgctcttcacagcaaccactttcccgtcgagatctttcacgcttttcacatcgttattgttagctttcaccatcactaacaggccgcttttgtagtagccgtcagagaaatcgatcgcttttttacgctcgtcggtgatggtaatgcccgccagcgccagatcgacgtttttggtttgcagtgccggaatgatcccactgaaatccatcggcttcagttcgtaatccagcttcagctctttagcgatggcagcccacagatcaacgtcaaagcccacatatttatcgccctgtttaaattcaaacggaacgaaggcggtatccgtcgcgacaactaattttttatccgcggcatgagaagaaaccgcaaaagccagggtcagtgcagccagtgaaacttttaatacagacttcatagcatttccttttttctatccacgggacgatcccctgcgtgacattcacatatatgaaaaaatcgtgccagttttgcaactccttgatttttcgagatgcggcaaaaacgtgatgcacgatttatagggcaataccctgaagatgcaccattctggggcaccaatctggtgcgctaaaattgtgcactcaacacagtgattatttagcgtaaaacctgatgaaaaaacaatctttatgtaacgattgtgtgatgatgtggatacaaaaaatttacttaatcagctggagatagcagatggatgcactaaataagtgcgttgaggtgggctgcaaaacaaaacggcctcctgtcaggaagccgcttttatcgggtactaaagttctgcaccatcagcgatggatttattcgatgttagactcgataaaccacaggaatttatccaggtcgcgagacgcggcggtcaggatatctgcggtgtcgtcatctttcgcttcgccaatcgctttgcgtacgtcattagcgacgattgcgtaacggtcagccagttctttcaggtgatcctgaacgttgtggatgtccagcgggtaacttttcagcggggttttgctgttgataacttgagtggtccccagagctacaccgcccagctgcactgcacgttctgccatggtatccagatgatcgatcagtgcggtgcggaagccatccagcatttcatgtacggcaatgaagttagcgccgcgcatgttccagtgcgcttgtttggtaatcaaagaaagatcaataaactggataacctggcgattcagcaactctactgttgcttttttctcgctgtcggagacatcgttgcgggtataaagcagattggtcgcttttgatttaactaatttagcggtactcataatttcatatcctcttgatgttatgtcccagtaattaacgagattaagtatagcaccggctatgtgttccgctattctggctgttcctatcacactaatagtggtaacaagcgtgaaaaacaaaactaataaagattcaatgagttagatatattgataagaacaattcttatttatctgctcgccaggaattttcggaataaatatgcttttgcataattcgatatataaagacggtgtagaggaaaagtagcgagaaattctgcatggttatgcataaccatgcagaaatgtaaatttaattaatgtctaattcttttattttgctctctttgcgtactgtcagcgtagaccccattgaagcggcgatgatagcgccgagcgccagtagctgtatgggtgtcagtgtttctccgaggaaaatcatcccggaaacggcagccagcgccggttccatgctcatcagcgtaccaaatgtccgtgttggcaaacgggtgagggcaatcatttccagcgaataaggcagagcggtcgagagaatagcgacagccagacccaatggaataaccgaccagtgccagagtgcttcaccagcctgaagcgctccaattggcacgaaaattaacgctgcaatcaacgaaccaattgccaccgtcgcagggccatgttccgctcctgcgcgttgcccacttaaaatgtaaatagcccaacaagccccggcccccagtgccagcgcacagccggttaaatcgacatgggaaacgtcttgccccagcggtagcaggaaccacagaccaagaaccgccagcacaacccagacgaaatctaccgggcgacgagaagagaacagcgccaccgccagtggtccggtgaactccagcgccaccgcaatacccagcggtactgtctgaatagaaagataaaaaagataattcatcccacccagcgaaacgccgtaaaacaacagcggtaaccgttgctctttggcaaagcgcagtcgccatggcttaaagaacgcgatgaggatcagcgttcctaatgccagacgcagcgcagtgacacccggtgcgcccaccagaggaaaaagtgacttagctaacgaggctccaccctgaatagacgccatggcaacgagcaatatgactattggtaaccagaccggcattttacgtaatgaaccaggcatcctttctcccacaaatatctagacttaagtaaagcgtggagtgtactggatatacccaatgctggttgagcatttgttgaaaaaattttcccccgttttgactaaaatgcgccaggattgatggaatcattagtctggtgattaggaataatctggatgaatgacagggaaaacatgcgtaatacttacgcagttctctgaaaaagtgatttaaatttagatggatagcggtgtatggaaacgttctgttacatgaaatggcccgttagacatcacaaatcgcgaagagtttcccattaatttttgatatatttaaaacttaggacttatttgaatcacatttgaggtggttatgaaaaaaattgcatgtctttcagcactggccgcagttctggctttcaccgcaggtacttccgtagctgcgacttctactgtaactggcggttacgcacagagcgacgctcagggccaaatgaacaaaatgggcggtttcaacctgaaataccgctatgaagaagacaacagcccgctgggtgtgatcggttctttcacttacaccgagaaaagccgtactgcaagctctggtgactacaacaaaaaccagtactacggcatcactgctggtccggcttaccgcattaacgactgggcaagcatctacggtgtagtgggtgtgggttatggtaaattccagaccactgaatacccgacctacaaacacgacaccagcgactacggtttctcctacggtgcgggtctgcagttcaacccgatggaaaacgttgctctggacttctcttacgagcagagccgtattcgtagcgttgacgtaggcacctggattgccggtgttggttaccgcttctaatcactttggtgatataaaaaatccgcctctcggggcggatttttgtttttaaggtttcgggtcgaaaatatcggttccgagatggttgtaatccaccttctgtaactggaagttggtgatgtatatcggcccggctttcttctcagatataaacgggtatttgatgttaatttccttcgctttaatccccgtccactgggagaaaaagcctaagaagtcattggctgagcggcgggctttaatcacacgatgcgctttatcgtcgctggaaatgaccataaaaggcacctggaaattttgctgatatttatcatcatgggcaaggtattgcacgtctttaccgcgctctttaaaggccagaccgtggtcagaaaagtaaaccagcgagaagctgctgccgctgttgcgtaactgatcgtacagcttgcgcagtaaatcgtccgtttgcgtcatggtatagagatagcacgacgtttctttcgattgcacaaaggtttcgtattttccttgtgtcctgtcgcaggcctgcggatgtgagcccatcagatgtagaacaatcagctgcggttgcgagtgctcttgcgccagcacttgagcggtcatatccagtaacgcttcgtctttggtgtttttatctgcttcaaaattaccttctttcaggaagtacacttcatctgctcgtttggcgatgctggcgatagcggtatcgtattcgccgatttgaccctggttggaaaaccaccaggtctggaagcccgcgcgatttgccagggtgacaaagttatcctgaaactgtggtttgccatcgacaacgcgattgagcgttaagccaagcgatttctgcgtggagccactggcggcaatgtagtcagcaaatatcaaaccgttaacgctgctggcaaacggggtattgtcccagtgaccgccaaaggcaccgagggcatcgcgacgcgcgctttcaccgatcaccaccacataggtctgatacttcggcttaacggcagtgaccgtccaggtatctttcattccggaaagttttgccatccgttcttgctcttcaatcacctcgttattattgacgatgacatccttagcaaaacgaaataccggatagccagtatctttcagtttaaatacgccaccccaggccaggttttgcacgggagcaacaaaaaatgtcgccacactgaataccagacacaggctgtcgaaggtattccagcgcgctttttcattctctttttttcgcctgattgctattacgccgagcgcaaaaataaataagccgaccaggtagctgtaccacggaaaaatcgtcaggatttcggtcgactcttccatattggtggagtgcaatgccagcaatgtattgaaattaggcgcgccgtaggcctgagcaaaagggaaataacaagccgccaccagcgaactgacaccgaccagaactttttgtacgcgaggcaatgttcgccatagcaaaagcaaaatagccgtaaacgcagcggtgtagagcaaactgaaggggtaacctaagccgaggttaattaatagcgactgtaaaaagtagaacgcagtccacgggctaaatacccggctacgggtaacaagcgattctttgagggttaaattcatatgccactatcgtaacaaacgccatgtgcttaccctggcgtcaagggtcaatacctgcaagagtgcgtgaagagtggaaaggggtccgcatccgcgagccgcaatatacgcagggctgcaagaagatagagcgagccgccgttcaggtcaactactgacgaacaaatcttttgcgaaggggattgcaaatccgacaaaaagtggggtttttcagaccaaaacgcgttatgcctgcatgaaagcaggagtgaagcggcgtaccgcgacgccgctatttatcggaaggtttatcttgctgcggtttgttgttgaccatatcgcacaacatagagagcagcattaaccgtactttaaagggagaatgactaaacacgcgcatacacctcttgaactcattcataagacctcctgacttgctaatcccgtcgatccttgagggatgattgcattacatacagatatagcacaggctatattatatagctattgctaaaacgttaattttttgtaccttcgcaactctggtttacaatgtgcgcacgaaatgagaacgctatgtatgcgtcaccataatgaggaagcacaatgagtcgtcgcgcaggtacgccaacagcaaaaaaagtgacgcagttagtgaacgtggaagagcacgttgaagggttccgccaggtcagagaggcgcatcggcgcgagcttattgatgattacgttgagctgatttctgacttgatcagggaagtgggggaagctcgtcaggtggacatggctgctcgtctgggagtttcgcaaccgacggtggctaaaatgcttaagcggctggcaaccatggggctgattgaaatgatcccctggcgtggcgtgtttttaacggcagaaggagagaagctggcgcaggaaagccgcgagcgacatcagatagtcgaaaatttcttgttggtgttgggcgtcagtccggaaatcgcccgtcgcgacgcggaaggcatggagcaccatgttagtgaagagacgctcgacgcttttcgtttgtttacccagaaacacggtgccaaatgagcctgccttttttacgcacgctgcaaggcgatcgtttttttcagttattaattcttgttggtatcggattaagctttttcgtgccctttgcaccgaaatcctggcctgctgctatcgactggcacaccatcatcaccttaagcggcctgatgctgctgaccaaaggtgtggagttaagcggttattttgatgtgctggggcgcaaaatggtgcgccgctttgctacggagcgtcggctggcgatgtttatggtgctggcggcggcgctgctttctacctttctgaccaacgatgtcgcgctgtttattgttgttccgctgactatcacgctaaaaagactgtgtgagatcccggttaatcggctgattatttttgaggcgctggcagtcaacgctggttcgctactgacgccaattggcaacccgcaaaatattcttatctggggacgttctggtctttcgtttgccggatttattgcccaaatggcaccgctggctggcgcaatgatgctgacgctcctgctcctgtgctggtgttgtttccctggaaaggcgatgcaataccatacgggggtgcaaacaccggagtggaaaccgcggctggtgtggagttgtctggggctgtatatcgtctttctgacggcgctggagttcaaacaagagctgtggggactggtgattgtggcggcaggctttgcgctgctggcacgtcgcgtggtgctcagtgtggactggacgctgctgctggtgtttatggcgatgtttatcgacgtccatttactgacccagcttccagcgttgcaaggcgtgttgggtaacgtgagtcatctatctgaacccgggttatggttaacggcaatcggtttatcgcaggtgatcagtaacgtgccgagtaccatattgttgctgaactatgtgccgccgtctttattactggtatgggcggtaaacgtaggtggctttgggttattacccggatcgctggcaaatttgattgcgctacgtatggcgaacgatcgccgcatctggtggcgtttccatctctattcaataccgatgctgttgtgggcggcgttggtgggatatgttttgttagttatactcccggccaactagggtctggcaaataaaaaaggcggattatgagtccgccttttgctttaagttttgaagattaattcagacgaaccggcatcccggagcggtttttaatcgcttcatcaagaacaacctggtcaacatctggctgaccggtcactgtctgcacgctcttcgtcagggtaattggcacaatttcctgaccttcaaactgggcttcggtggtagacagcgggttatggacttcaatataacggctgccgtctggctcggtggtcgcttttaccggctcatcaataaactgtacgcgggtaccgaccggtactttctcgaacaggaatttgatgtcttcgttacgcagacgcacacaaccatgacttacacgcaggccgataccgaagttggcgttggtgccatggatagcatacaggcgaccgatatagagtgcatacagccccatcgggttatccggacctgccggaacgacagccggaagcggttcgcccgcagcgcggtactctgcgtgcattttggcggtcggcgtccaggtcgggcctgcttttttacgctcaactttggtggtccagttgataggcgtatctttgcctaactgaccaatgccgatcggcagcacgataacggtgttggtccctttcggatagtaataaagacgcatctcagcactgttaatgacgatgccttcatgaacggtatccggcaggatcagctgctgcggaatgttcagtacagtaccgcctttcggcaggaaggtatccacacccgggttcgcttccatcatattggaaagccccatctggtactcggcggcaaaatactccagcggctgagtgttaccttcaggaatggtgatcacctgattctgaccaaccaggcgactcccgtcggttggcagaggataagttaccgcagaggcggtactgcaaaagccgacaacagcgaaggccgctgcgaataatgttttcaatttcatattcatgttaagcgagattttgtgcctggcaggccattgggttgagaatattagagtattggaagcgcattataagttcattccagctcacagtgaaatcagatgtgtacgaaatcacattttttgcctttggcttgagtgtagaccttaagcgaggagcaggatcttctttcagacttatggcataatgcgcggtttgtcatatctcttttcaggatacgcctgtgttagtttccagtaacgtcaccatgcagttcggcagtaagccgttgtttgaaaacatttccgtcaaatttggcggcggcaaccgttacggcctgattggcgcgaacggtagtggtaaatccacctttatgaagatcctcggcggcgaccttgagccgacgctgggtaacgtttccctcgatcccaacgagcgcattggtaaactgcgtcaggatcagtttgcctttgaagagttcactgtgctggatacggtgatcatggggcataaagagttgtgggaagtgaagcaggagcgcgaccgcatctatgctttgccggaaatgagtgaagaagacggctataaagtggccgatctggaagttaaatacggcgaaatggacggttactctgcggaagctcgcgccggtgaactgttgcttggcgtgggaattccagtggaacagcactacggcccgatgagtgaagttgctcctggctggaagctgcgtgtgcttctggcgcaggcgctgtttgctgatccggatattctcctgctcgacgaaccgaccaacaacctcgacatcgacaccattcgctggctggaacaggtgctgaacgagcgtgacagcaccatgatcatcatctcgcacgaccgtcacttccttaacatggtctgtacccacatggcggatctggattacggcgagctgcgcgtttatccgggtaactacgatgagtacatgacggcggcgacccaggcgcgtgaacgtctgctggccgataacgccaagaagaaagcgcagattgctgagttgcaatctttcgttagccgctttagcgccaacgcctcgaaatctcgccaggcaacttcgcgcgcgcgccagattgataaaatcaaactggaagaggtgaaagcctccagccgtcagaacccgttcatccgttttgaacaggataagaaactgttccgtaacgcgctggaagtggaaggtctgaccaaagggtttgataacggtccgctgtttaaaaatctcaacctgctgctggaagtgggtgaaaaactggcggtactgggtaccaacggcgtcggtaaatcaacgctgctgaaaacgctggtgggcgatctgcaaccggacagcggcaccgtaaaatggtctgagaacgcgcgcattggttactatgctcaggaccacgaatatgagtttgaaaatgatctgaccgtgttcgaatggatgagccagtggaagcaggaaggcgatgacgagcaggcggtacgcagtattctcggtcgtttgctgttcagccaggacgacatcaaaaagccagctaaagtgctttccggtggggaaaaagggcggatgctgtttggtaagttaatgatgcagaagccgaacattctgatcatggacgaaccgaccaaccacctggatatggaatccattgagtcgctgaacatggcactggaactgtatcagggcacgctgatctttgtttcacacgaccgtgagttcgtaagctccctggcgacccgcattctggaaatcaccccggaacgcgtgatcgactttagcggtaattacgaagattacctgcgtagtaaagggatcgagtaagtgattatccgtcaccccgatactgtcggggtgacggcggctgatgacaaatgcaaaatagcctgatgcgctacgcttatcaggcctacgcagtacctgcaatatattgaatctgcaggactttgtaggccggataaggcgttaacgccgcatcaggcattaacaaagcgcatttgtcagcaatctgagtaacgtcgaatcgattttcttaatcccacatcaattcacttccattaattctcaaacatccatgcccaacgctcgcttaccgtgaatgttgaggtcggcaagcgtaaagcgtccttcccagtttgtttcatagtcctcgcgcgggaagtcgcccggcgatgcgcctttttccagtgcggccttcaccttgtgcgcgtaggcaagatttttctcgcacatcggtgccgcaggaatgtacatcacgttgccccaaccttgttgattttcaacgggggcaacggaatggatgacgtcgcagtgccaccagacggagtctccggcttcgagttttggaatgctggttaacgcctcaatcaacagtggatgccattgctctgataccggcaatactcttccgggcgctacgccgcacagttcatcctccggcacatcatcaagcagcggacgtaacagtacgtacgccatagcttcaggaatgggcacgacgtgcagcagcccctgaccaggcagcatatcagagagcgctgtccagccctggaatgtccgaaacacggaacatttggtggtgttgtccaccgtgtactcttcaacttccgtacgatgtgccgcatgccagggatcatattgcgccagattgccattaaagacgttggcgaaaacgcgctgatacgctggaagcagccagcgttccagtgccccggagtcggtatgcgctccaagacctttggaggtcgttccgggcggacggcggcggatacggtcagggtagatgacgctcacatccgggttaaaccattgctttccatcactttcaaatgtccacagacgattgagaaacgactgcgcattcgccatttcttcactctggcgggcctgcatttgcgcctgcgaccagtagatggggtaaatctcgggacgtgaagcgctgagcgtcccgaagaaattatcgccggggcctttgtagacctcgtcaaagcggttgcggtccagatagtccagcatcgactgatcccagcctagcgcttgttcgcgggggaaatggccttttatcaccgcacaaccgcgacgtttaatctgttcgcgctgctctgcagtaacatgacctgctttgatatcggcataagacagcaccggccagacggcatcgccctgtgctttgagtgcgttgatttcagccactcgcgtggcaatgtcatcgcttagctgattaaagatctgctggacgtcgccaagctgcgcccgcagcgcgtgcttcatctgacggatagctgctttgtgatcggcaggcaatgtgtcgctggtaaaagtagaagccataaccacctctcattaactttcattcgaaaccattctgatttgcatgtgacaatataagttataaataagttaatgcaagtttaatgatttgatgtgatgtacaggatgtaaaaagaagggaaaaccggagcgcacggctccggtagagaggtcagctgttaaaaggggatgtgttatccagcaccgcctgaatcacattcagcgcgccttcatgattattatcatcggtagcgtaacgggcgatttgtttaatgttttccgcagcattgcccatcgcaaaggaataacgcgccattttcagcatctccgcatcgttaccgctgtcgccaatcgctaccacattttgcggtgacagatcccagcgtttcagtaaccgcgaaataccgtttgctttatgtagaccgggaataatcaggtcgataaagccaaaaccactggtaacgggtttcataatgccatcgagcgctacgtgcagtttgtcgatcactaacgggatttgttcatccggcaggttgagcgaaaacttgaacagtacgtcgtcaatctcctgataatcttttacaggtttcaggcgatggtagtgttttgccatcagtgcgacaaatgcttcgggggcattttcgctgacatatgcactttgcagaccgcaggcgacaaaattgagttgcttatcttttagcaactcgccaataacaatccgcgattcatgtcgggtcagttcgccgtggaacaactgcttgccatgttcgtaaaccagtgcgccgttttccgcgacaaaagagatctcatcctttagctcaggaaagaatgaaataagctggtaatactgattaccgctggcaacaacgaacttaatgccgcgctttttcagttcctgatattgcgccataaaacgtggttggttgtacgttttggcgtcgttaagaaaagtaccgtccatgtctgtgacgataacttttacgctcataggtgtgctcctggctcgaaaatgaaaccgtaacagtgtaataacaatgtgacgcagagcacaaattatatttcgaatgaaagtaaggatgaaattgatgatgtgaatgatttagcccggcgacgacgccgccgggccgaggagattacagcatatgttcagtacgggcgatgatatcgtcctgagcgtctggagagagcgcggtgaagaacgcggaatagcccgcgacacgcactaccagatcgcgatactgatcgggatgttttttcgcatccagcagcgtttcgcgggaaacgatgttgtactgaatatgccagcctttatgcacttcaaagaaggtacgcagcaggatcatcagtttctgcttgtcagattcgttctccagcgttgccggattcagtttctggttgagcaacacgccgccgagaatcgctgccgtaggcagtttacccactgagccaatgaccgcagtagggccaagatggtcagtaccggaggccgggcttgcgccttctgccagcggggtgtgggctttacgcccgtccggtgttgccatagtctgcgcgccaaacggtacgttagcggagattgatgacgtacccgcgtaatagttgccgccaaccggaccacgaccgtagcgcggattatggtactgtttcagttcgtcgatataggtctgataagcgcgagccagcagcgtatcgacagtatcatcgtcgttgccgtacttcggcgcaccgttaatcagccgctgacgcagctgctcgtgagtcaggccgtcgaagtcatctgccagtgcggcagcaagctgttgctgaccaatcgcaccttgttcaaacaccagtttcttcactgccgccaggctgttgccgaggttggcaatgccgacctgcaggccagaaacccagtcatatttcgcgccgccttgcttgatacttttcgctcgctcaatacagtcatccaccagcgccgagcagagaatatcgtgcacgttctcttccagcatggtgtcgacgacatattcgatttcgattgatttgcgggtgtagtaacggatttgcgtatcccacgcgtccatcacttcatcgaagttgttgaagttacctgccgacaacgctttttcttgtggcaggaacactttgccgctggtggcatcatgcccgccttccagcgccgccagcatcacgcgggcgaagttgataaagctcatgccggtacagcgatagccccatttgccaccgacggcggtttctatacaaccaatcgctgcgtagtcataagcgtcctgcggttcaataccgagtttaataaattccgggatcacgatttcgtcgttgttgaacgccggcatcccgaagccgcaacggatcacctgtacgcaggcgtcgaggaaatcgttgctcattcctgcatggtaacgcacgctgaggttaggctgagtggaacgcaggcgaccgcaggattcgaggatcgcgtaagagagtggattcaccgcgtccattggttgaccatcaaccagattttgcccgccaatagtgacgttctgatacagcggacttcccgcagaggcttttgagtgtgagccggagcggatcttgttcacttccagcagtttcagccagcagctatgcagcatctcgatggcgtgttcgcgatccagcgtctggttgagttcaacgtcgcggcgatagtacgggtagagatactggtccatacgaccaaacgatactgagtgaccgttagattcgatctgcaaaatcaactggatgaagtaacacagttgcagcgcctgccagaaagtctgcggcggctggtgggcgataagatcgcagttttctgccatcgccagcagttcatcgcgacggctttcgcgggtttcggtcgcggccatttcacgcgccagggcagcgaaacgttcaatgtgttcactgactgccaccagcacgatatcaatcgctttcaggaattgctcaccgtgtaaatcttccagcaccgtcaggttgatgcgcgagcgacgttccgctacttcctcgcgcagaccatcaagccctttttccagcagcagcgggaaattcaccgccaggtgcgcatcgccggaggtcatattgccttccgctttaatgattccggtcgccagcagacctttttgctcatcggtaaacatgccgtagcagcgatcctgtacggtctgaccgcgccaccacgggcacacttcatgcagaacgcgtttgttctcttcgctcaccgcaaagccagcaccgggacgatctgccagatcatcaatctctttttcgatccacgagacagtatattccgggaagatcggcgcggcgcgaacttcgcttgcctggttgccaatgatcaactcatcgtgtttgatccagatggtgcgattcgccaggtgatgcgccagtgccagcgcgcgacgtaccgggatcggcttatcgagatgttgttgatacatctcggtatagtgctgcgcgcgctcggtacagactggcggtttcacaatatgcaccagcgcatttttgtgcgctttaatgcggtcgctgagcgtgtccagtttcagtgtggtcatggttgttatcctcgtaaggtcgcggttaaccctttctggcaggcatactgctgggcaaagtcgagcagttctggcgcatcaagcggtttttccggggcgtcatagggcagattaagtaagtgatatttgttgatgcccagcgtgtggtagggcagaaaatgaatttcgccaacgtgcagctcgtcggcggcaaaatcggtaatggcttttacagaggtttcgtcggcattaaagccctgaatcagcggcacgcggataatgatttttttgcccgctgcggcgagttttttcaggttatccagcactctggcggcgttaccgtcggtccactgtttaaacggcgcgtcggcaacgtgttttaaatcggcaagaaacagatcgatatagggcagagaaggggcgatatatttccacggcacatgcagacaggtttctaccgcagtatgaatgcctgcctcgtggctggcttgcagtagcgccatcgccatttccggctgcataaagggctcaccacccgaaagcgttaaaccgccgccgctgcgatcgtaaaacggtttatcgcgcagaacggtcgtcatgatctcctcaacgcttttcacttcaccacacacggttaatgcctgtgtcggacagcagtcggttaacgccgtcagatgctccggggttaacttttcccgatgaataagcaaaccattcagcgcgcgctcaatcacttccggcgcggccttagcgcacagctcgcagccttccagacacagtcgtgcgtcatacagcagatcctgcgtgcgggcgcggctttccgggttctgacaccagcggcagcccagcgaacagcctttaagaaatacgaccgtgcggataccggggccatcatgggtcgagtagcgctgaatattgaaaatcatagttgcctctctatttcgttcaagcattaaaatactttcgaatgaaagttagattgatgtgcgtcaactgttcagagagttttcccgtgatagtctacattcagacaaaaagtacattttgaggatggttatggaactgtatctggatacttcagacgttgttgcggtgaaggcgctgtcacgtatttttccgctggcgggtgtgaccactaacccaagcattatcgccgcgggtaaaaaaccgctggatgttgtgcttccgcaacttcatgaagcgatgggcggtcaggggcgtctgtttgcccaggtaatggctaccactgccgaagggatggttaatgacgcgcttaagctgcgttctattattgcggatatcgtggtgaaagttccggtgaccgccgaggggctggcagctattaagatgttaaaagcggaagggattccgacgctgggaaccgcggtatatggcgcagcacaagggctgctgtcggcgctggcaggtgcggaatatgttgcgccttacgttaatcgtattgatgctcagggcggtagcggcattcagactgtgaccgacttacaccagttattgaaaatgcatgcgccgcaggcgaaagtgctggcagcgagtttcaaaaccccgcgtcaggcgctggactgcttactggcaggatgtgaatcaattactctgccactggatgtggcacaacagatgattagctatccggcggttgatgccgctgtggcgaagtttgagcaggactggcagggagcgtttggcagaacgtcgatttaaccggacgttctgcatcctcataaattgctgatgacgtggcggagtgccgcgtcttatcaggcctggaggtggcaattactgcccacacacctcacaccccggattacgcatcagtttcatttcgcgaaactgacaggtcatcgcatcgtacatgacgattttcccgctggccggtttgccataacctgccagcattttgatcgcttccattgcctgcaacgaaccaattacgccgatcaacggtgccattacgcctgcttccacgcaggttaatgcattttcaccaaacaaacggctaaggcagcgatagcacggttcaccgtcctgataagtaaagacggtgatttgaccttccatacgaattgccgcgccggaaaccagcggtaccttcgcggcaaaacagcctgcgttcagttgattacgtaccgcaacgttatccgtacagtcgagcaccagatcgtgttcagcaatcaatgctgcaagttctgcgtcatccagcagtgcattgactggcgtaatcgcgatatgtgggttgatccgcgtcagggcgtcacgggcggattccaccttcggttgcccgaccgtggcatcactgtgcagtgtctggcgttgcagattcgagagcgaaaccgtgtcgaagtcgagcagcgtcaggttaccgacaccggcgcttgccagatactgcgaggctgcacagccgaggccgcccaggcccactatcagcacgcgagaatctttcagcgcctcctggccgtcaaaatcaaagccgcgcagaatgatttgccggttgtagcgcagcatctcctgatcgctgagttccgccattacaggcctccgaacaacgcgttaaacggttctacttccacccattcgcccacttccacattgccgcgatcgcgttccagcacgataaagcagttgccgaggctaaaggagctaaatatatgtgaaccctgatgtccggtggtcgtcacttccagttcgccatcggcgttgcgttgcagcacgccgcgctggaaatcaagacgtcctggcgtttttttcaggcgggacgctgtgcgtacgcgctggcgcgcgggcaggccgctggcggtgttaccgcttagttttgccagcaaaggctgtaccagttgatagaaggtcagcgtcgctgaaaccgggttgcccggcaggccgcagaaccagctattgctgagtttaccgaacgcgaacggtttacctggtttaatcgccagcttccagaaggcgatctcccccagctcttcaagaatcgttttggtgtaatccgcctcacccactgaaacaccgccggaactgatcaccacatccgcctggctgtcggcttcaataaatgcggcgcgcagggcatggggatcgtcgcggataatccctaagttaattacctcgcatcccaactgttctaacatcaggtgtacggcgagacggttggtatcgtagatttggccgtcgcccagcggctgaccgggcaactggagttcatcaccggtagaaaaaagcgctacacgcactttacgaatcaccggaacttcggcaatccccagtgaagcaattactggcagctctgcggtagtcaggcgagttcccgccgggaaaacaaccgcacctgcagagatatcttcaccgcgacggcgaatattttgcccgctacgcacttcagcagtaaaacgcacgccattgtccatttgttcagtctgctcctgcatcaccaccgcttcgcagccttccggcaccggcgcaccggtcataatacgaatgcaggtacccgcaggccattcaccatggtatggctgaccggcaaaggatttaccggcaacgggcagcggttgcccggaggcaatatcggctaaacgcaccgcgtagccgtccattgcggagttatcaaaccccggaacatcaagcggcgaaacgacatcgctcgccagaatacgaccaaaacactgtaccagtggcagcgtttcctgggcggtcagtggggtgacgcgagaaagcatctcattaagcgcggtgtcgagcgacatcaatccggtggtaaattccatgaaaacactcctgcggaggcaaaatcgaatttgcctattatgtcagaaaaacgccacagactgtatgccacctcgggcgtagcgctgggtcctgcctttacatgccatatccatctttctatattcaaaaattgaatgagtaattcataaaaattctgatatttatagcaaaagtggcgaaccacccttaatggacgaatactatgggcaaagcagtcattgcaattcatggtggcgcaggtgcaattagccgcgcgcagatgagtctgcaacaggaattacgctacatcgaggcgttgtctgccattgttgaaaccgggcagaaaatgctggaagcgggcgaaagtgcgctggatgtggtgacggaagcggtgcgtctgctggaagagtgtccactgtttaacgccggaattggcgctgtctttacgcgtgatgaaacccatgaactggacgcctgtgtgatggatggtaacaccctgaaagccggtgcggtggcgggcgttagtcatctgcgtaatccggttcttgccgcccggctggtgatggagcaaagcccgcatgtgatgatgattggcgaaggggcagaaaattttgcgtttgctcgtggcatggagcgcgtctcgccggagattttctccacgtctttgcgttatgaacaactactggcagcgcgcaaggaaggggcaaccgtcctcgaccatagcggtgcgccactggatgaaaaacagaaaatgggcaccgtgggggccgtggcgttggatttagacggcaatttggcggcagccacgtccacaggcggaatgaccaataaattacccggacgagttggcgatagtcccttagtgggtgccggatgctacgccaataacgccagtgtggcggtttcttgtaccggcacgggcgaagtcttcatccgcgcgctggcggcatatgacatcgccgcgttaatggattacggcggattaagtctcgcggaagcctgcgagcgggtagtaatggaaaaactccctgcgcttggcggtagcggtggcttaatcgctatcgaccatgaagggaatgtcgcgctaccgtttaacaccgaaggaatgtatcgcgcctggggctacgcaggcgatacgccaaccaccggtatctaccgtgaaaaaggggacaccgttgccacacagtgatgaacttgatgccggtaatgtgctggcggttgaaaatctgaatattgcctttatgcaggaccagcagaaaatagctgcggtccgcaatctctcttttagtctgcaacgcggtgagacgctggcaattgttggcgaatccggctccggtaagtcagtgactgcgttggcattgatgcgcctgttggaacaggcgggcggtttagtacagtgcgataaaatgctgttgcagcggcgcagtcgcgaagtgattgaacttagcgagcagaacgctgcacaaatgcgccatgttcgcggtgcggatatggcgatgatatttcaggagccgatgacatcgctgaacccggtatttactgtgggtgaacagattgccgaatcaattcgtctgcatcagaacgccagtcgtgaagaagcgatggtcgaggcgaagcggatgctggatcaggtacgcattcctgaggcacaaaccattctttcacgttatccgcatcaactctctggcgggatgcgccagcgagtgatgattgcgatggcgctgtcatgccgcccggcggtgctgattgccgatgagccaaccaccgcgctggatgtcactattcaggcgcagatcctgcaattaatcaaagtattgcaaaaagagatgtcgatgggcgttatctttatcactcacgatatgggcgtggtggcagagattgccgatcgggtactggtgatgtatcagggcgaggcggtggaaacgggtaccgtcgaacagatttttcatgcaccgcaacatccttacacccgtgcgctgttagctgctgttccgcaacttggtgcgatgaaagggttagattatccccgacgtttcccgttgatatcgcttgaacatccagcgaaacaggccccccccatcgagcagaaaacggtggtggatggcgaacctgttttacgagtgcgtaatcttgtcacccgtttccctttgcgcagcggtttgttgaatcgcgtaacgcgggaagtgcatgccgttgagaaagtcagttttgatctctggcctggcgaaacgctatcgctggtgggcgagtctggcagcggtaaatccactaccgggcgggcgttgctgcgcctggtcgaatcgcagggcggcgaaattatctttaacggtcagcgaatcgataccttgtcacccggcaaacttcaggcattacgccgggatattcagtttatttttcaggacccttacgcttcgctggacccacgtcagaccatcggtgattcgattatcgaaccgctgcgtgtacacggtttattgccaggtaaagacgcggctgcacgcgttgcgtggttgctggagcgcgtgggcctgttacctgaacatgcctggcgttacccgcatgagttttccggcggtcagcgccagcgcatctgcattgctcgcgcgttggcattgaatccaaaagtgatcattgccgacgaagccgtttcggcgctggatgtttctattcgcgggcagattatcaacttgttgctcgatctccagcgtgatttcggcattgcgtatctgtttatctcccacgatatggcggtggtagagcggattagtcatcgtgtggcggtgatgtatctcgggcaaattgttgaaattggtccacggcgcgcggtcttcgaaaacccgcagcatccttatacgcgtaaattactggcggcagttccggtcgctgaaccgtcccgacaacgaccgcagcgtgtactgctgtcggacgatcttcccagcaatattcatctgcgtggcgaagaggtggcagccgtctcgttgcaatgcgtcgggccggggcattacgtcgcacaaccacaatcagaatacgcattcatgcgtagataacattcaggcggagaataaaatggcaagagctgtacaccgtagtgggttagtggcgctgggcattgcgacagcgttgatggcatcttgtgcattcgctgccaaagatgtggtggtggcggtaggatcgaatttcaccacgctcgatccgtatgacgcaaatgacacgttatctcaggccgtagcgaaatcgttttaccaggggctgttcggtctggataaagagatgaaactgaaaaacgtgctggcggagagttataccgtttccgatgacggcattacttacaccgtgaaattgcgggaaggcattaaattccaggatggcaccgatttcaacgccgcggcggtgaaagcgaatctggaccgggccagcgatccggcgaatcatcttaaacgctataacctgtataagaatattgctaaaacggaagcgatcgatccgacaacggtaaagattaccctcaaacagccgttctcagcgtttattaatattcttgcccatccggcgaccgcgatgatttcaccggcagcgctggaaaaatatggcaaggagattggtttttatccggtgggaaccggaccgtatgaactggatacctggaatcagaccgattttgtgaaggtgaaaaaattcgcgggttactggcagccaggattgcccaaactggacagcataacctggcgtccggtggcggataacaacacccgcgcggcaatgctgcaaaccggtgaagcgcagtttgctttccccattccttacgagcaggccacactgctggagaaaaacaaaaatatcgagttgatggccagtccgtcaattatgcagcgttatatcagtatgaacgtgacgcaaaagccgttcgataacccgaaggtccgtgaggcgctgaattacgccattaaccgtccggcgctggtgaaagttgcctttgcgggctatgcaacgccagctactggtgtggtaccgccaagtatcgcctacgcgcaaagttataaaccgtggccttacgatccagtgaaagcgcgcgaattactgaaagaggcgggatatcccaacggtttcagtaccacgctgtggtcgtcacataaccacagcaccgcgcagaaagtgctgcaatttacccagcagcagttagcgcaggtcgggattaaagcccaggtgactgcgatggatgccggacagcgggcggcagaagttgaaggtaaagggcaaaaagagagcggcgtgcggatgttctacactggctggtcggcttcaaccggcgaagcggactgggcactatcgccgctgtttgcctcgcagaactggccaccgacgctgtttaataccgcgttttacagcaataaacaggtggatgacttcctggctcaggcactgaaaactaatgatccggcggaaaagacccgcttatataaggcggcgcaggatatcatctggcaagaatcgccgtggatcccgctggtggtagaaaaactggtgtcggcacacagtaaaaacctgaccggtttttggatcatgccagacaccggcttcagctttgaagacgcggatttgcaataagcaacgcagggagtggaatgcttaattacgttatcaaacgcttactggggttgattccgacgctgtttatcgtctcggtgctggtgtttttatttgtccatatgctgcccggcgatccggcgcgattgattgccgggcccgaagctgatgcgcaggttatagaactggtgcgtcagcagctggggttggatcagccgctgtatcaccagttctggcactatatcagcaatgctgtgcagggggattttggcctgtcgatggtgtcgcgtcgtccggttgccgatgagattgccagccgctttatgccaacgctgtggctgaccataaccagtatggtctgggcggttatatttggtatggcggcgggaattatcgccgccgtctggcgtaaccgttggccggatcgattgagtatgaccattgcggtgtcggggatctcgtttccggcatttgctctggggatgcttttaattcaggtattctccgttgaactgggctggctgcctaccgtgggagcagacagttggcagcactacattttaccctccctgacgctcggcgcggcagtggccgccgtgatggcgcgctttacccgcgcgtcgtttgtcgatgttttaagcgaagattatatgcgtaccgcgagggcgaaaggggtgagcgaaacctgggttgtcctcaaacacgggctacgtaacgcgatgatcccggtagtgaccatgatgggcttacagtttggctttttgctcggtggttccatcgttgtggagaaagttttcaactggccgggacttggacgcttactcgttgactccgtagaaatgcgtgattacccggtgattcaggcggaaattctgcttttctcgctggaatttattcttatcaacttagtggtggatgtgctttacgccgccattaacccggctatcaggtacaagtaaggatgcgactatttaactggcgacgtcaggcggtgttaaacgccatgccactggtcaaacctgaccaggtacgtacaccgtggcatgaattctggcgacgatttcgccgtcagcatatggcgatgaccgccgcattattcgttattttattgattgtggtggccatttttgcacgctggatcgctccctatgacgccgaaaattattttgattatgacaatctgaataacggaccttctttgcagcactggtttggcgtcgattcactggggcgtgacattttcagccgtgtcctggttggtgcgcaaatctcgctggcggcgggcgtgtttgccgtgtttatcggtgcggcgatcgggacgttgctgggcttgctcgctggatattatgaaggctggtgggatcggctgatcatgcgcatttgcgatgtgctgtttgccttcccgggtattttactggcgatcgctgttgttgcggtgttgggaagcggcattgctaacgtgattattgcagtcgccattttttccatccccgcgtttgcccgcctggtgcgcggcaacacgctggtgttgaaacagcaaacctttattgagtcagcacgcagtattggtgccagcgatatgaccgttttgttgcgtcatatcctgcctgggaccgtctcttctatcgtggtgtttttcaccatgcgcattggtacctcgattatctctgccgccagcctctcatttctcggcctcggtgcgcagccgccgacaccagagtggggagcaatgctcaatgaggctcgagcggatatggttatcgcgccgcatgtcgctgtttttccggccctggctatttttctgaccgtactggcgttcaatttgttgggcgatggtttacgcgatgcgctggatccgaaaattaaaggatagttacgtttgaatattgcttgaaagggtaatcacctcacaggaaattattgccctaagcaagtgttgtaactttctgctgattttgtagaatcgggtaatttggttaaaaagccgcagcaagggacaatttttgcagcggcacagcgttcagatagttattttgttaaatgtattaacatgctgagtttatacgaaaagataaagataaggctgataattttatttttattggcagcactgtcatttattggtctttttttcatcattaactatcaactggtatcggagcgcgcggtaaaacgtgccgatagccgctttgaacttattcagaaaaacgttggctatttctttaaagatattgaacgttcggccctgacattaaaggactcactgtatttattaaaaaatacagaggagattcaacgcgccgtgattcttaaaatggaaatgatgccatttttagactcggtgggactggtacttgatgataataaatattatcttttttcgcggagggcgaatgataaaatcgttgtttatcatcaggaacaagtaaatggaccgcttgtcgacgagtcagggcgggttatttttgccgattttaacccatcgaaacgaccgtggtcggtggcttcagatgactctaacaacagctggaatccggcatacaattgctttgatcgtccgggtaaaaaatgtatctcttttacgctacacatcaacggcaaagatcacgatttgttagcggtggataaaattcatgtcgatttaaactggcgatatctgaacgagtatcttgatcaaatcagcgctaatgatgaagttctatttttgaaacaaggccatgagatcattgccaagaatcaactcgctcgtgaaaaactgattatttataatagcgaaggtaattataatattattgattctgtcgatactgaatatatcgaaaaaacatcagcggtgccaaacaacgcattattcgaaatctatttttattatcctggcggtaatttattgaacgcatcagataaacttttttatctgccgtttgcgttcattattatcgtattgctggtggtttatttaatgaccactcgtgtgttccgtcggcaattttctgaaatgacagagctggttaatacgctggcgtttttgcctgactcaacggatcaaatcgaggctctgaaaattcgtgaaggcgatgcgaaagagattatcagcatcaaaaattcgatcgcggaaatgaaagatgccgaaattgaacggtcaaataaattgctctcactgatctcttacgatcaggaaagtggttttattaaaaatatggcgattattgagtctaacaataatcagtatctggctgtggggatcatcaaactgtgtggtctggaagccgtggaagcggtgtttggtgttgatgagcgcaataaaatcgtcaggaaattgtgtcagcgaattgccgagaaatatgcgcaatgctgcgatatcgtgacattcaatgccgatctctatttacttctgtgtcgggaaaatgtacagacatttacccgtaaaatagcgatggtaaacgattttgacagcagctttggctaccgcaatctgcgcatccataagtctgccatttgtgaacctttgcagggggaaaacgcctggagttacgcagaaaaactgaaactggcgatttccagtatccgtgaccatatgttctcagagtttattttctgtgatgacgcgaaactcaacgaaatagaagagaatatctggattgcgcgtaatattcgccatgcaatggaaattggcgaactattcctcgtctatcaaccgatcgttgatattaacacccgcgccattctgggcgcggaggcgttgtgccgttgggtgtctgcggagcgggggatcatttcaccgctgaagttcattaccattgctgaagatatcgggtttatcaatgagctgggttatcagattattaaaacggcaatgggtgaattcagacattttagtcagcgtgcgtcgctgaaggatgatttcttactgcatattaatgtttcgccctggcagttaaacgaaccacactttcatgagcgttttaccaccatcatgaaagaaaatggcctgaaggcgaacagcctctgtgttgagatcactgaaaccgtgatcgagcgaattaatgaacatttttatctcaatattgaacaactgcgtaaacaaggggtacggatatcgattgatgactttggcaccggtttgtcaaacctgaaacgtttttatgaaattaatccagacagcataaaggtggactcgcaattcaccggcgatattttcggtactgcgggaaaaattgtgcgcattattttcgacctggcacgctataaccggatcccggtgattgcggaaggcgtagagagcgaagacgttgcgcgcgaattaatcaaattaggatgtgttcaggctcaggggtatctgtaccagaaacccatgccattctccgcctgggataaaagtggaaaattagtaaaagagtagtttacgtatgtccagaatcaataagttcgtacttacagtcagtctgctgatttttatcatgatttcagcagttgcctgcgggatctacactcaaatggtaaaggaacgggtgtatagcctgaaacagtccgttattgatactgcttttgcggtggcaaatattgctgaatatcggcgtagcgtggcaattgatcttatcaacacgctaaatcccacggaggaacagctgttggttggtttgcgcacagcttacgccgactcggtttccccctcttatttgtacgatgtcggtccttatctgatttccagtgacgaatgtattcaggtaaaggagttcgagaaaaattattgtgcagatattatgcaggttgtgaagtatcgacatgtcaaaaatacagggtttatctcttttgacggtaaaaccttcgtctattacctctatccggtaactcacaatcgtagtctgatatttttgcttggtctggagcgtttttctttactgtcaaaatcgctggcgatggacagcgagaacctgatgttctctctatttaagaacggtaaaccggtgaccggtgatgaatataatgctaaaaacgccatcttcaccgtttcggaagcgatggagcacttcgcctatttgccgaccggattgtatgtatttgcgtataaaaaagatgtttatttgcgggtttgtacattgattattttctttgccgcattggtggcagtgatatcgggtgccagttgcctctatctggtacgcagagtgattaatcgtggtattgtggagaaagaagccatcattaataaccattttgaacgcgtactggatggcgggcttttcttttcggctgccgatgtcaaaaaactctacagtatgtataactcggcgttcctggacgacctgaccaaagcaatgggcagaaaatcctttgacgaagatttaaaagcgctgccggaaaaaggcggttatttgtgcctgtttgacgtcgataaattcaaaaacattaacgacaccttcggtcatttgctgggcgatgaagtgttgatgaaagtggtgaaaatccttaaatcacagatcccggtagataaaggtaaagtctaccgcttcggcggtgacgaatttgcggtgatttatacgggtggaacgctggaagagttgctatcgattctaaaagaaatcgttcatttccaggtgggaagcattaatttaagtaccagtatcggtgtagcacattcaaatgaatgtcctaccgtcgaacgcttgaaaatgctggcggatgagcggctgtataagagtaagaaaaacggcagggcacagattagctggcagtaatcattattcgcaggccggacaaatgattttgcccggcctgaattaattaaacccggctaccccacaaatcgtactcatcggcgtgctcgactttcacacgcaggatatcacccggcttaacgttggtttcaccattgagataaaccgcgccgtcgatttccggtgcatctgccatgctgcgaccaatcgcgccttcttcgtccacttcgtcgataatcaccagaatttcacggcccactttctcttgcaggcgctcggcggaaatctgctgctgcagctgcatgaaacggttccagcgttcttctttaacttcttccggaacctggtcaggcagggcattggcgtctgcaccttcaaccgggctgtatttaaagcagccaacgcgatccagacgcgcttctttcaggaagtcgagtagcatctggaaatcttcttctgtctcgccagggaagccgacaataaaggttgagcgtagggtcagttccgggcagatttcgcgccactgtttgatgcgcgccagttggcgatctacagaacccggacgcttcatcagtttgagaatgcgcgggctggcgtgctgcaacggaatgtccagatacggcaggattttgccttctgccatcagtgggatgacgtcgtccacatgcggataagggtaaacgtagtgcagacgtgtccagatccccagtttcgataactgttcgcacaggctgaccatgctggtttttaccggctcgccgttgtggaagccagtacgatgtttaacatcaacgccataggcggaagtatcctgcgagatcaccagaatctctttaacgcccgcatctaccagacgtttcgcttcacttaacacttcgccaatcggacggctcaccaggtcgccgcgcatagacggaataatgcagaaggtgcagcggtgattacagccttcagaaattttcagataggcataatgacgcggcgtcagtttcacaccttgttctggcaccaggctcaggaatgggttgtgtttcggttttggcacgtagtgatgaacgtgctccagaacctgctcatagctatgaggcccggtgatttccagcactttcgggtggacttcgcggatctgatcttcttttgcccccagacaaccggtcacaataaccttgccgttttcattcaacgcttcaccaatggcttccagtgattcttgtaccgcgctgtcaataaagccgcaggtgttgacgatcaccatgtccgcatcgtcatagctcggtaccacgtcataaccttcagtgcggagttcggtgagaatacgctctgaatcaacaaggtttttcggacagccaagggaaacaaagccgattttcggctggggagttactttgctcatagcttaaaaaatattcagttacaggaaaggtcagggcagggattctacagagttctggataaaatttgtatcgcaatctcattcgctggcggaggcgaaggaaatgtaaattttgttaattcggcgtgaagaattgatcctggacagcattttgctcaaaaaatagccatactatttaattgcaacaaggctgggaagaggaggatcgaagtatgttcgttgacagacagcgaatcgatctgctgaaccggttgatcgacgcacgcgttgacctcgccgcatacgtgcaactgaggaaggcaaaaggatacatgtccgtcagcgaaagcaatcatctacgagataacttttttaaactgaatcgcgaactgcacgataaatcgctgcggttgaatcttcatctggatcaggaagagtggagtgctcttcatcatgctgaagaagcattagcgacagccgcagtatgtttgatgagtgggcaccatgattgcccgactgttattaccgtcaacgccgataagcttgaaaattgtctgatgagcttaacgctgagtatccagagcctgcagaagcacgccatgcttgagaaggcctgaaaactaagggggagaaagcgtctcccccttcatgtttaagtttttgtaaaaatgaatttgttatctcctccactgactacgctttaagccagagtcaatccggaggcgttatgcatcgacaatcctttttccttgtgccccttatttgtctttcttccgctctctgggcggctcctgcaacggtaaatgtcgaagtactgcaagacaaactcgaccatccctgggcactggcctttttacccgataatcacggtatgttaatcactctgcgcggcggcgagttgcgtcactggcaagcaggaaaaggattatctgcgccgctttccggagttccggacgtttgggcgcacgggcagggcggcctgctggacgtggttttagcgcctgattttgctcagtctcgccgcatctggttaagttattccgaagttggcgatgatggcaaagccggaactgctgtgggttatggccgcttaagtgatgatctctcaaaagtgaccgacttccgcaccgtctttcgccagatgccaaaactgtctaccggcaaccattttggcgggcggctggtattcgacggtaaaggttatctttttattgctctgggcgaaaacaatcagcgcccgacggcgcaggatctggataaattacagggcaaactggtgcgtctgaccgaccagggcgaaatcccggatgataatccttttataaaggaatccggtgcgcgcgccgagatctggtcttatggcattcgtaatccgcaaggaatggcgatgaatccgtggagtaatgcactgtggctgaatgaacatggcccgcgcggtggtgatgaaattaatatcccgcaaaaaggcaaaaactacggctggccgctggcaacctggggaatcaactattcaggctttaagataccggaagcgaaaggggagatcgtcgccgggaccgagcaacctgttttttactggaaagattcgcccgctgtgagcggcatggccttctataacagcgataaattcccccagtggcagcaaaaattatttattggcgcgctgaaagataaagatgtcattgtgatgagcgtcaacggcgacaaagtgacagaagatggccgtattttaacggacagagggcagcgaattcgtgatgttcgcactggacccgacggttatttatacgttctcaccgacgagtccagtggggaattacttaaagttagcccacgcaattagctaacgggaatcatcaccactttgcgcactgcggggcgttcagtgagttgctgataccagcgttgcagatttggacgcggtgtccaggtcaggccaacgttaaacaaattgtagatgaacggtgcgatagcgatatcgcccacaccaaactcgtcgccagagaaccattttacttttgccagttccgcatcgagcagggcaaacagggcgtcgcactctttgcaactggcatcaatggcggcctgatcgcgctcttccggtggtgttctgactaatcccatcaggatcccgcgatgagcattactgagcgtctggtttgcccagtccatccatttttccgcttccgcacgacgtgccggtgagtcgatccacaggcgtttttgcccgtactgtgccgccagatagcggacaatggcgtttgattcccaaagaatgagatcactttcgtcgtcacgcaacaacggcaccagcccgttagggttcatcgccagaaaatcagcatcgtgatttatcccaaactcacggcccgcgagaatttgctcataaggtagttccagttcttcgagcgtcagcaatactttttttacgttagttgaattattccgaccccacagcgtaatcatactcaccccttttccgacaggcagccacaggctgaacaggactccgatggtgaagtaaagttaacttttaagcaacagctggcaaaaaaatgacaccagaagcagcgaagcggcaggatattgcataaactttaaaaactttaccaacttacggtttctttaagtttgtgtgtgcgttattaatcaccaaacttatcatacggcgatataacgtattttttttgaatggatactcgggtggcatttatgacgcaatactcctctctccttcgtggtcttgcagcgggttctgcatttttattcctttttgccccaacggcattcgcggcggaacaaaccgttgaagcgccgagcgtggatgcgcgtgcatggattttaatggattacgccagcggtaaagtgctggcagaaggcaatgcggatgagaaactggatcccgcgagcctgactaaaatcatgaccagctatgtggttgggcaggcgcttaaggccgataagattaaactcaccgatatggtgacggtcggtaaagatgcctgggcgacgggaaatccggcactgcgtggttcatcggtaatgttcctcaaaccgggcgatcaggtttcggtggcagacttgaacaaaggtgtgattatccagtccggtaatgacgcctgtattgcgctggctgattacgttgccgggagccaggagtcatttattggtctgatgaatggttatgccaaaaaactgggtctgaccaacactaccttccagacggtgcacggcctggatgcgccggggcagttcagcaccgcgcgcgatatggcattgctgggtaaagcattgatccacgatgtgccggaagagtacgccattcataaagagaaagagttcaccttcaacaaaattcgtcagcctaaccgtaaccgtctgctgtggagcagcaatctgaatgttgatggcatgaagacaggaaccacggcaggcgcgggatataatctggttgcttcggctacccagggcgatatgcgtttaatctccgtagtgttgggggcgaaaaccgaccgtatccgttttaatgagtctgagaaattattgacctggggtttccgcttctttgaaaccgtgacgccaattaaacctgatgccacctttgtgactcagcgcgtctggtttggtgataagagcgaagtgaatctcggggcaggtgaagcgggctcagtgaccataccgcgtgggcagctgaaaaacctgaaagcgagttatacgttaacggaaccgcagcttaccgcaccgctgaaaaaaggtcaggttgtcgggaccattgatttccagcttaacggtaaatccattgagcagcgtccgctgatcgtgatggaaaatgtggaagagggcggattctttggtcgggtgtgggatttcgtgatgatgaaattccatcagtggttcggcagctggttctcttaatcttctgataaccggatggcgcgaaacgtcatccggttatacgtcattaatacatcaacttaatgcgctgcgtctgcgcgtacttcacatactcatcttccgggcaacaatcgctcaccacaatatcaaagcgtttcaggtcacccatgcgcgccggacgcaccttgccaaatttactgtggtcgacaaccagcacatgcttttgcgccatcgacatggcccagtgttttaccggcaactcttcaagattaaaacaggtagcgcctttactgacatgcacgcccgccgcagaataaaaagcgatatccgggcaaaaattattcagcgtttgctgaaaatcgatgggtttgaaaatggcgttgctggcgtgaaattcaccaccgcaaagaaacgcgcggcaatggggtttctctttcagcgccagaaaggtatttagcgaataacaaacggcggtaaaagggatttcattatcaatcgcttcaataatccacggcgtggtggtgccacagtcaaaaaagagggtctgatcgggttctaccagcgtcgcagccagttttgccgcccggcgtttttcttccaccaggcgggatttttgatcgcttaacaggtaatggctggcactgcgcggttccagaacaatatagccgccgagcaaaacgacgggcgcactgtggttgttcagatcgcgacgaatcgtcatctccgaaaccccaagcagggcggcggcgtctttaagatgtaacttatcgctgcgttttaattcttgcagcagctgcccgatacgctcttcgcgacgtgtttccataatccctctgaatagttattgaagcgagccgctcaatactacactttttagcagagatcagtcacgcacccagcctttgcggatcggtaatgcaaaacagacgcgataccacgattgcagacgttgatagagtttatgccccatcgcttgccagataatctgggcactaaggcagccaatcatacctgccagcaatccaccgagcatatccagcggccagtggacgccaagataaacgcgcgaccaggcaatgacgacggccagcaccattaaaagtgagccggaccacaggcgatgccagcataaaaatgccagtgcaaaggtgaaaatcaccgtaccgtgatcgcttgggaatgagtcatccgccgcatgatgcaggaagttatagccgatattttcgacaaagggtcggtcgtgcggaaaaagatgtcccatcgtccaggacacaaacaggctgaccgccagcgcgatagcgatttttatcaccagttgccgttgtgctgtaagcccccacaaccaaagtaccacggccagcaacggcaccacggtaatcaaatctttagcaataaaaatcgccaacgagatcatccacggagccgagtctggcgtcgcgttaataagagagaatagagagagattcaaattttccagcataacttcccgacgcaaagtgattaaaagggagccaatacaggcaagtcgttgagaataaagtgcaggttaaactgggtaaagcggcatcgtcttatttccctcaagcggcctgtttacggtgggtgattgtaacgggcataggttaaataaaacttaaagaaagcgtagctatactcgtaataatgtaagaatgtgcttaaccgtggtttcagctacaaaattcgctttctcgttagctgcgcttttattaaactctgcgcgattattattggcgaagaaattgcatgcaaaataaattagcttccggtgccaggcttggacgtcaggcgttacttttccctctctgtctggtgctttacgaattttcaacctatatcggcaacgatatgattcaacccggtatgttggccgtggtggaacaatatcaggcgggcattgattgggttcctacttcgatgaccgcgtatctggcgggcgggatgtttttacaatggctgctggggccgctgtcggatcgtattggtcgccgtccggtgatgctggcgggagtggtgtggtttatcgtcacctgtctggcaatattgctggcgcaaaacattgaacaattcaccctgttgcgcttcttgcagggcataagcctctgtttcattggcgctgtgggatacgccgcaattcaggaatccttcgaagaggcggtttgtatcaagatcaccgcgctgatggcgaacgtggcgctgattgctccgctacttggtccgctggtgggcgcggcgtggatccatgtgctgccctgggaggggatgtttgttttgtttgccgcattggcagcgatctcctttttcggtctgcaacgagccatgcctgaaaccgccacgcgtataggcgagaaactgtcactgaaagaactcggtcgtgactataagctggtgctgaagaacggccgctttgtggcgggggcgctggcgctgggattcgttagtctgccgttgctggcgtggatcgcccagtcgccgattatcatcattaccggcgagcagttgagcagctatgaatatggcttgctgcaagtgcctattttcggggcgttaattgcgggtaacttgctgttagcgcgtctgacctcgcgccgcaccgtacgttcgctgattattatgggcggctggccgattatgattggtctattggtcgctgctgcggcaacggttatctcatcgcacgcgtatttatggatgactgccgggttaagtatttatgctttcggtattggtctggcgaatgcgggactggtgcgattaaccctgtttgccagcgatatgagtaaaggtacggtttctgccgcgatgggaatgctgcaaatgctgatctttaccgttggtattgaaatcagcaaacatgcctggctgaacgggggcaacggactgtttaatctcttcaaccttgtcaacggaattttgtggctgtcgctgatggttatctttttaaaagataaacagatgggaaattctcacgaagggtaaaaaaatgcctgactgctttgtgcgatcaggcattctcgaattaatggtgatggtcgtcaatctggtgttcgataaccatcccttcacctacgctggcaagatggcgaacataaggatgcgggcggtaagccggagctggcgcaggagccacatagacggtttgcggcacagtcgcgacgctgaccgcttgtggaacgctgactgaatcaggaaccacaaccactttgtatccactcggcacatcgacggtgacactttgcgccatcgccacaccagtaaagcccattaaaagcgcgcccaacagtagacaatttttcataatcatttcgcctgaaataatgcagcgggttaatttccgcgaattatgcagccttcattcaggcattgtgttgccgggcgtgctgccggttttattggtcaaatggcgcttcgtgtttaagaactttatcgatcacatccagtacgccttcacggttattggagcctgcgcggtattttgccgctgcgacgaccgcgctaccggcattttccattgcaaaactaaagcctgcctgacgcagcatctcaatatcgttaccgccatcgccaaagaccaccacttcgctgtcgtctattccccataatttctgcagttggcgaaggccattggctttatgtacgccggggataatcagatcgatgctgccgttgccggtgtggaccgacaccataatatcgccgatggcctcatgtaatgctttttgtacttgtggaatcagttcatcggaaagattcaggccaaacttaaagaagatatcctctaagttgtcaaagttatcgacgtattccagacggtgataatacatttccgccaccgttttcatggcatcgtcatattttttgagtgtataggcactattttttccgcaggcaataatttccacttccgggcgcgtcagcaaatgttccacgacagtagcaaacgcatccttcgatagctcgccattaaaaacatctttgccttcgctcactacccagccgccgttttcagccacaaaggcaatttcattagcaatttcagggaagaaagagatcaactgataatattgattcccgctggcgactacaaagcgaattccttgtgctttcatttgctgatactgagccataaaccgctcacggttataggttttttgatcgcttaagaaagtaccatccatgtctaccgcaattaatttaatgctcatcaactattctccatcgccgtctgcgttttggtatcgggtttggcgacggctttcgcgacaatagccgcgagaataaccagcgccagtacaaccagcattgcactacgtaatccataatgttcgccgagatagcccagcagcggcggcccgacgaggaaagccagataaccggtcgttgctaccacactgacgcgggttggtgcatcggggccggtatcgctggcggcagaaatggtcagcgggaagcccagcgaggcacccagtccccagagtacaacagacaccccagcgacccaggcgctatcgacaaaaataatcagcccaatacccaacgcccccattagtgcactggcccgaaccacggcaacgcgactgtaacggtcgatgaaccaaccgccggtgaagcgtccaacggtcatccccagggtaaaaccggcataaatcagcgagccggaagtagggctaaaaccgtgaccgtcaaccattaataagggtaaccagtcgttggcagaaccttcggcaaaggccatcgccagcaccacaacacctatcagcagcaactggatatcgcgataaaaaggtacgcctttttcgccatgctgggtgccatcggcagcatttttgcccgtaccgtcagggattgcctgaatggcgatataaataggtgcgatacctaccagcgccgccaataaaatgtgcaccgttgccggaacgccaaaggccgtcagtgccatcccgacacctgcgcctgccagcgtgcccaggctataaaaaccgtgcatcatcggcaaaaccgtcttattcatttctcgctcaacggcagcaccttcaacgtttatcgccacttccgcagaaccaaaacttgccccaaagacgccgagaccaacggcaaagagcaggggcgatgtcagccagagtgccagacttaatatcatcatcccgatcaatgcgcaggacatcgtgaccaggatgacattacgtgtcccaaagcgtttcactaaccacgccgagcagagaataccgctcatcgaaccgatcgacagaccaaagagaacaccgcccatttcagcgatcgagacagagagaatatcgcggatagcaggcgtacgggttgcccaggacgccattaacaggcctggcaaaaagaagaacataaacagcgcccaggttcggcgtttcaatgcattacgtgaagaatttacggtcatagatcacgtcaaaataagaagagggaagacaacattagcaaggttgtgtacatttgtacacaattgcagagagaggaaatgacatgcgtcgcgctaacgatccgcaacggcgagaaaaaattatccaggccacgctggaggcggtgaaactttacggaatacatgctgttacgcaccgcaaaattgctacccttgccggggtaccgttgggatcgatgacctactatttttcaggaattgatgagttgttactggaggcgttcagcagttttactgagatcatgtcccggcaatatcaggcattttttagcgatgttagtgatgctccgggcgcatgccaggctatcaccgatatgatctacagctcacaggttgcaacgccggataacatggagctgatgtaccagctctacgcgctggctagccgaaaaccgctattaaaaacggtaatgcaaaactggatgcagcgcagtcagcaaacgctcgaacaatggtttgaacccggaaccgcccgcgcgcttgatgcgtttattgaggggatgacgctgcattttgtcaccgaccgtaagccgctatcgcgcgaggagattttgaggatggttgagagggttgcagggtagtagataagttttagataacaaaaaacccatcaaccttgaaccgaaatggcggggttgatgggctccacaaaatggggacatcaaagaaaagcagtggcactaattaagactgatgccctgcggaaaagttctgcggttgtgcaaaaaaatttcattttcagggcaacttcagttttatcctaatcctggccataccatgacgatgattgtccctgccagcgtcagcaggacgttggcgattgcataggtgcccgcatagcccagcgccgggatgttactgcgagctgtatcactgatgatctccattgccggcgcgcaggtacgtgcgcccatcattgcgccgaacaacagcgcgcggttcattcgcaatacataagcaccgaacaagaaacagataaccacgggcaccagactgacaatcaatccggcaatcaacatctgaccgccaatcgcgcccaggccgttattaataccgctaccggcgctcagaccaacgcctgccataaacaccatcaagccgaactctttcaccatgcttaatgcaccctgcggaatgtaaccgaaggtcgggtggttagcacgcataaagcccagcataattccggcgaataacaacccggcagcgttccccatgccgaaactgaatgtgctgaactggaaggtgatcatcccgatcatcagcccaataacaaagaaggcgcagaatgccagcaggtcagtgacctggctgtgaatcgagataaagccgatgcgatcggcgatggtttttacgcggcgggcatcgccgctgacttgtaaaacgtcacctttgttaagcacgacgttgtcatctatcggcatctcaatctggctacgaatgacgcggttaaggaagcaaccgtgatcggtcaacttcagttgtgcgagacgtttacctacagcgttatggtttttaacgaccacttcttcagtgacgatacgcatgtcgagaaggtcacgatcgaaaacttctttaccgttacggaagctgggatcgagtcgggcatgggcgtcgggatagcctaccaacgctatttcatcgcccatttgtagcacggcatcaccgtctggatttgccagaatcccgttacgtcgaatacgttcaatgtagcagccggtttgtcgataaatacccagttcacgcagatttttgccgtcggtccaggccaccagttccgggccgacgcgataggcgcggatcaccggtaaataaaccttacggttggcatcagtgtccaggccacgttcgcgggcgatttgctgggcgctggtctgtaagtcctgatgctgcaatttcggcaagtaacgcgcaccaacaatcaaactcaccagaccgattaaataggttaaggcatacccgaggctcagattatccagtgccagtgagagctgcctgctttccatgccggaatgacgcagtgtatcgccagcaccgaccagaaccggtgtcgacgtcatagagcctgctaacataccggccgtcaggccaatatcccagccaaacagcttacctaaccctaaggcgatcaccagcgcactgccaaccatcaccagtgctaacattaggtaatttttcccatcgcgaaaaaaaatggaaaaaaagttcggtccggcttcgaccccgacgcagaaaataaacagcataaagccaagattaagcgcatcggtgttaatgctgaaatgttgttggcctaataacagcgatacgactaaaacgccaatggaattacccagttggatcgaaccaagtcgtaactttccgagacatagcccaagcgcgaggaccacaaataataacagaatgtaattcccatttaacaattcggcgacgtttatattcacggaggctaacttcttgtttactagtaagctgttgaaagaaatggtaatttacgataatgttttttaccagaattcagggcgcagattcattcagcgcacctaaacgatagtaaagtaacaatatattttactagtgtaatcacattaggtatcaacggctatatgaattgcgttggcctatattagcatggaatgcgaagcggctttatcttactgaacgccacactggcgaaaaatgtgttcgatagacgcagtgtcaggaggaacgagtgaaacataaacaacgttgggcgggggcaatctgctgttttgtcctcttcattgtggtgtgcctttttctggcgacgcacatgaaaggcgcttttcgggctgccgggcatcctgaaatcggcttgctatttttcattcttcctggagcagtcgccagcttcttttcacagcgtagagaagtcctgaaacctctgtttggcgcaatgctggcggcaccctgttcgatgctcattatgcggctgtttttttcaccgacgcgctcattctggcaagagctggcatggttactaagcgcggtgttctggtgtgcgctgggggcactgtgtttcttatttatcagtagtttgtttaaaccacagcacagaaaaaatcagtaaagccctcaacgcgagggcttgtcagacgatcaggcgtccagattttctttcacccatgcagcaaaatcggtatagccgccgatatgttgctgatcgacaaaaatctgcggcacggtttctacgggtttacctgccttttgttgtagatcttctttagtgatcccttccgcacgaatatctacatactgatactgaaaatcatcgcgttcattgctcaatttctcagccagatcttttgcacgcacacagtaagggcaacccgaacgaccaaaaataacggtttgcattatttctctcctcatagatttatgcctgtaatgatcacgctaaaatgtattcgctgaaagtaggtttaacctgttgcattaattgctaaaagctataactgttaaacacaatacagtgaaaagttttagactgaaggctcactttgcagagggaagcgtatgcgcgcgatcggtaaattgcctaaaggcgtgttgatactggaatttatcggaatgatgctactggcggtggcgctgctgtcggtaagcgactccctgtcgctgcctgagccattttctcggccagaagtgcagattctgatgatttttctcggtgttttgctcatgcttcccgctgcggtggtggttattcttcaggtggcaaaacgtcttgccccacagctgatgaaccgtccaccgcaatattcacgttcagaaagagaaaaagataatgacgccaaccattgaacttatttgtggccatcgctccattcgccatttcactgatgaacccatttccgaagcgcagcgtgaggcgattattaacagcgcccgtgcgacgtccagttccagttttttgcagtgcagtagcattattcgcattaccgacaaagcgttacgtgaagaactggtgacgctgaccggcgggcaaaaacacgtagcgcaagcggcggagttctgggtgttctgtgccgactttaaccgccatttacagatctgtccggatgctcagctcggcctggcggaacaactgttgctcggtgtcgttgatacggcaatgatggcgcagaatgcattaatcgcagcggaatcgctgggattgggcggggtatatatcggcggcctgcgcaataatattgaagcggtgacgaaactgcttaaattaccgcagcatgttctgccgctgtttgggctgtgccttggctggcctgcggataatccggatcttaagccgcgtttaccggcctccattttggtgcatgaaaacagctatcaaccgctggataaaggcgcactggcgcagtatgacgagcaactggcggaatattacctcacccgtggcagcaataatcgccgggatacctggagcgatcatatccgccgaacaatcattaaagaaagccgcccatttattctggattatttgcacaaacagggttgggcgacgcgctaaaaccgccacgtcgatgtatgatacgcgggcttttgaccaggtctgacagagaggtgcagggtgaaaattgccatattgtcccgggatggaacgctctattcgtgtaagcggctgcgtgaagccgctatacagcgcggtcacctggttgaaattcttgatccgctttcttgctacatgaacataaatcctgcggcgtcttctattcactacaaaggccgcaagttaccccattttgacgcagtgatcccgcgtattggcaccgccattaccttttatgggacggcggcactgcgccagttcgagatgctggggagctatccgctcaatgagtcggtcgccattgcccgggcgcgtgacaaattgcgttccatgcaactgctggcgcgtcagggcatcgacctgcctgtcacgggcattgcgcattcgccggatgataccagcgatttaatcgacatggtcggtggtgcgccgctggtggtcaagttggttgaaggcacgcagggaattggcgtcgtgctggcggagacgcgtcaggcggcggaaagcgtgattgacgctttccgcggtctgaacgcgcatattctggtgcaggaatatatcaaagaggcgcaagggtgcgatatccgctgtctggttgttggcgatgaagtggtcgctgcgattgaacggcgggcgaaagagggcgattttcgttccaatttgcatcgtggcggcgcggcaagcgtcgccagtatcacaccacaggagcgtgaaatcgcgataaaagccgcgcgaacgatggcgctggacgttgctggtgtggatattctgcgtgctaatcgcgggccgttggtgatggaggtgaatgcgtcgccggggctggaaggaatagaaaaaaccaccggtatcgacatcgcgggtaaaatgatccgctggatcgaacgccacgctacgacagaatattgcctgaaaacgggtggttagtcgcaatcacattactgatcatggttttgcctgcgctttttgcgtaagctgtgccggtctttttatcgaaagaggttgtacaaaattatgacatcgctggtcgttcctggtctggatacgctgcgtcaatggctcgatgacctggggatgagtttttttgaatgtgataactgtcaggctctgcatctgccccatatgcagaatttcgacggtgtctttgatgccaaaatcgatctgatcgataacacgatcctgttttctgccatggcggaagtccgaccttcagccgtattgccgctggcggcggatttatctgccatcaatgccagttcgctgaccgtgaaagcatttcttgatatgcaggatgataatctgccaaagctggtggtttgccagtctttatccgttatgcagggcgtaacctatgagcagtttgcatggttcgtgcgtcagagcgaagagcagatttcgatggtcattcttgaagctaatgcccatcaactgctgttaccgactgatgatgaagggcaaaacaacgttaccgaaaactatttcctccactgataactcctttcgagcacgcagtcgctggtgcagtggctgcgcgctgcaaaattatctgctgtttttaaccttttcttaaagattatttcacttctcttgtgtcgatttggctttatcacatagagcaaatatgcataaaaatttgttaaataccgttttttaatccgagctatagtctcaaaccctggctaaagttattcttgcgatgcttttatatagcgagcagtgctggccgggagaaagttctcttttcttacaccgcgccgataaaaaatatgcacgtttattgcatatctttcagtgtgacaacttttgttcgtttgttaacgaactttcagaaggaaagagatatgaccgccttaaataaaaaatggctatcgggtctggttgcgggtgctctgatggccgtctctgtcggcacgctcgcggctgaacaaaaaacactccacatttataactggtctgattatatcgccccggacacggtggccaattttgaaaaagaaaccggtattaaagtcgtctacgatgttttcgactctaacgaagtactggaaggcaaattaatggccgggagtaccggctttgatctggtggttccatctgccagctttctggagcgccagttgactgcgggagttttccagccgctggacaaaagcaaattgccggagtggaagaatctcgacccggaactgctgaagctggtcgccaaacacgatcccgacaataaatttgctatgccctatatgtgggcgacgaccgggattggctataacgttgataaagttaaagcggtgctgggcgaaaacgcgcccgtcgatagctgggacttgatcctcaaacctgaaaatctggaaaaactgaaaagctgcggtgtctctttcctggatgcgccagaagaagtttttgctaccgtgttgaattatctcggcaaagatcccaacagcactaaagcggatgattacaccggaccggcaacagatctgctgttaaagctgcgcccgaacattcgttatttccattcatctcaatacattaacgacctggcaaacggcgatatttgcgtcgctatcggctgggcaggtgatgtctggcaggcgtcaaaccgcgcgaaggaagcgaagaatggcgtgaatgtctcgttctcgattccaaaagaaggggcgatggcgttctttgatgtattcgccatgcctgcggatgccaaaaacaaagacgaagcctatcagttcctgaattacctgctgcgcccggatgtagtagcgcatatttccgaccatgtgttctatgccaacgccaataaagcagccacgccgctggtgagtgcggaagtccgtgagaacccaggtatttatccgcctgcggatgttcgtgcgaagctgttcactctgaaagtgcaggatccgaaaatcgaccgtgtgcgcacccgcgcgtggaccaaagtgaagagcggaaaataatccgcagtcgtagatgccggaggggcgcaccacacccgccggcaattcgcaccattatggtgcgcttgcacacattcaatgccggagagcagccgtgaatgacgctatccctcgcccgcaggcgaaaacccgtaaggcgctgacgccgctattagaaatccgcaacctgaccaaatcctacgatggtcaacatgcggtggatgatgtcagcctgaccatctacaaaggtgaaatcttcgcgctgctgggcgcatccggctgtggcaagtccacgctgctgcgtatgctggcaggtttcgaacaaccttctgccggacagataatgcttgatggcgtcgatttgtcacaggttccgccttacctgcgccccatcaatatgatgtttcagtcttacgcgctgtttccgcatatgaccgtggaacagaacatcgcttttggcctgaaacaggacaaactaccgaaagcggaaattgccagccgggtcaatgagatgctcggcctggtgcatatgcaggagttcgccaaacgcaaaccgcatcagctttccggtggtcagcgacaacgtgtggccctggcccgaagccttgcgaagcgcccgaaactattactgctcgatgagccgatgggcgcgctggataaaaagctgcgtgacaggatgcagcttgaagtggtggatattctggagcgcgtcggtgtgacttgtgtgatggtcacccacgatcaggaagaggcgatgaccatggcggggcgcatcgccattatgaatcgtgggaaatttgtccagattggcgaaccggaagagatctacgagcatccgactacccgctatagcgccgaatttattggctcggtaaacgtctttgaaggcgtactcaaagagcgtcaggaagatggcctggtgcttgattcgccggggctggtgcatccactgaaagtcgacgcggatgcctcggtggtcgataacgtgccggtacatgtggcgctgcgcccggaaaaaatcatgctttgcgaagagccgcccgccaatggttgtaacttcgcggtgggggaggtgatacacattgcctatctcggcgatctttcggtgtatcacgttcgtctgaaaagtgggcagatgattagcgcccagctacaaaacgcccatcgtcatcgtaaagggttaccgacctggggcgacgaagtgcgtttgtgctgggaagtggacagctgtgtggtgctgacggtttaaggagcaaagatgagtacacttgaacctgctgcccagtcgaaaccgccgggcggatttaagctgtggttgtcgcagctgcaaatgaagcatgggcgcaaactggtcattgcgttgccatatatctggttgatcttgctgtttctgctgccatttctgattgtctttaaaataagcctggcggagatggcgcgcgctattccaccttataccgaactgatggagtgggctgacgggcaactgtccatcactcttaatctcggtaattttctgcaactgaccgacgatccgctctatttcgatgcttatctccagtcgctacaggtggctgcgatttcgacattttgctgtttactgatcggctatccgctggcgtgggcggtggcgcacagtaagccttcgacccgtaatattttattactactggtgatcctgccgtcgtggacctcgtttctgatccgcgtttatgcctggatgggaatattaaaaaacaacggtgtgctgaataattttctgctgtggctgggggttatcgatcaaccgctgaccattctgcataccaatctggccgtttatatcggcattgtttacgcttacgtgccgtttatggtactgccgatttataccgcgttgattcgtattgattattcgctggtggaagcagcgctggatctcggtgcacgaccgctgaaaacgttctttactgtgatcgtgccgctgactaaaggtgggattattgccggatcgatgctggtgtttatcccggctgtgggcgagtttgtgatcccggaactgctcggtggcccggacagcatcatgatcgggcgcgtgctatggcaagagtttttcaataaccgcgactggccggtggcctcggcggtagcgatcatcatgttgctgctgctaattgtgccgataatgtggttccacaaacaccagcaaaaaagcgtgggagaacacggatgaataatttaccggtagttcgttcgccctggcggattgtgattttgctgctgggctttacctttctctacgcgccaatgctgatgctggttatctattcgtttaacagctcgaagctggtgacggtgtgggccggctggtcaacgcgctggtatggtgagttattgcgcgatgacgcgatgatgagtgcggttggtttaagtctgacaattgcggcctgtgcggcgacggcggcggcgatcctcggaactattgcggcggtggtgctggtgcgctttggcaggtttcgcggatcaaatggctttgcctttatgatcaccgcgccgctggtaatgccagatgtcatcacgggcttgtcgctgttgttattattcgtcgcgcttgctcatgccattggctggcctgcggaccgcggtatgctcaccatctggctggcgcatgtcactttttgtacggcttatgtggcggtcgttatttcttcaagattgcgggaactggatcgctcgatagaagaagcagcgatggatctcggtgcgacgccgctgaaagtgtttttcgtcattacgctaccgatgatcatgcccgcgatcatttctggctggttactggcttttactttgtcgcttgatgatctggtgatcgccagctttgtttccgggccgggagccaccacgttaccgatgctggtcttttccagcgtgcggatgggggtgaatccggaaatcaacgccctggcaacattgatcctcggcgcggtcggaattgtcggatttatcgcctggtatctgatggctcgcgcagaaaaacagcggatacgcgacatccagcgtgcaagacgtggctgaagacactaaaatttgccaacctggctacataatgccgcgcatgtcgcggcattgttttcatggaagacgaaacgttgggattttttaagaaaacatcttcatctcatgctcgcctgaatgtgcctgcgctggtgcaggtggcggcgctcgccattattatgatccgtggcctcgacgtgctgatgattttcaatacgctgggcgtgcgcggtattggcgagttcattcatcgcagcgtacaaacctggagtttaacgctggtctttttaagcagtctggtgctggttttcattgagatctggtgtgcgttttcactggtgaaagggcgtcgctgggcgcgctggctatatctgctgacacaaatcaccgccgcaagttacttgtgggcggcttcgctggggtacggttatccggagctgttcagcattcccggtgaatcaaaacgtgaaatcttccatagcctgatgctgcagaagctgccggatatgctcatcctgatgctgctgttcgttccctcgaccagtcggcggttcttccagttgcaataatgtgtataatcgtcgcccctgatgatgtgaaggtcaatgtatgcagtgcgcactttacgacgcgggtcgctgtcgttcctgtcagtggataatgcagccgattccagagcaactctccgctaaaaccgccgatcttaaaaatctgctcgccgactttccggttgaggaatggtgcgcgccggtgtcaggcccggaacaagggtttcgtaataaagccaaaatggtggtgagtggtagcgttgaaaaaccactgctcggtatgctgcatcgcgatggcacaccagaagacctttgtgactgcccgctttatcctgcctcatttgcgcccgtttttgcggcgctaaaaccgtttatcgcccgagcggggttaacgccctacaacgtggcgcgtaagcgtggcgaactgaaatacattctgctgactgaaagccagagtgatggaggcatgatgctgcgctttgtactgcgttctgataccaagctggcgcaactgcgtaaggcgctgccgtggttacacgaacaactaccgcagctgaaagttattaccgtcaatattcagccggtacatatggcgattatggaaggggagacggagatctacctgaccgaacaacaggcactggcggagcgttttaatgacgtaccgctgtggatccgtccgcaaagtttcttccagactaatccggcggtcgccagccagttgtacgccaccgcgcgcgactgggtacgacagctgccggttaaacatatgtgggatctgttctgcggtgtggggggctttggtttacactgcgcgacgcctgacatgcagttaaccgggatcgaaattgcatcagaggccattgcctgtgcaaagcagtcagccgctgaactgggcttaacgcgtttgcaatttcaggcgctggactccactcagtttgccaccgctcagggggatgtgccggagctggtgctggttaacccgccgcgccgcggcattggtaaaccgctgtgtgattatctctcaacgatggcaccgcgttttatcatctactccagctgtaacgcccaaactatggcgaaagatatccgcgaactgcctgggtttcgtattgaacgggtgcagcttttcgatatgttcccgcataccgcgcactatgaagtgctgacgctgctggtgaagcaataaaaaagccgcatgtgcggcttcagattgctgacaaagtgcgcgttgtttatgccggatgcggcgtaaacgccttatccggcctacaaaagcgtgcaaattcaatacattgcatgggccatgtaggcctgataagcgtagcgcatcaggcaattttacctttgtcatcagtctcaagccgcggttgcggctttctgaatcttactgtgggaaccactggtcactgattttttgataagtaccgtcagctttaattgctgccagcgcgttattcagtttttccagcagggctttgttatccggacgtacagcgatgcccaggccggtgccaaaatattgcggatcggtcactttctcagtagcaacaccaagttgtggattggttttcagccattcgtttaccaccgctgtgtcaccaaataccccatcaatacgaccatttttcagatcgataaaggcattctgataactgtcataagagacagttttcacttccgggtgctgatcctgaatatatttctggtgcgtagtaccgttttccatcccaatacgtttgcctttcagatcggcaaacgttttgtaggtatcttttttggcaatcacgacggctgagttttcatagtagggcgtggtaaacgatacctgtttgctacgctccggggtgatatccataccggagattacggcgtcatattttctgaatttcagggacgggatcaggctgtcgaacgcgtgattagtaaaagtacattctgcctgcatttgtttgcacaaggcttttgccagatcgatatcaaagccgacaatctcattattagcacctatagattcaaagggtggataggtggctgaaacgccaaaattgattttctctgcggcagaagcaccgaaagtaaaggaagcaagtaaagcggcaagaactaactttttcatgatggaactcccgtctgtcaatcttatgatttttggccgtgtctgcggcatgggataacaatgccatcaagtgaatttatatgcaataaacatgattaaataatttaaatgaaataaaaaagacggacaacttagtgggttgtccgtcttcattataagaatttatgcactatgtaggccggataaggcgtccccgccgcatccggcacaggcaccgtgctgatgtctgatgcgacgctggcgcgtcttatcagacctacaaaaccccccggcgaatgtacgcagccacattaatttcgccgttcgaatgccagcgctttgcgctcgatcagacgcatcatcagcgtcagcaggccgttaacgaccaggtaaataatccctgccgcaccgaacaccattacatcgtaggtgcgtccgtacaacaactggctgtatcccatcacttccatcagcgtaatggtgtatgccagagaggtacttttgaataccagcaccacttcgttggaataagaagagagcgagcgtttaaaggcatacggcagcaggatcgccagcgtatcttttttgctcattcccagggcgctacaggactgccactgaccttccgggatcgcacgaattgcaccgtaaaacagctgcgtggtatacgccgcactattcagcgacaacgcaatcagcgcacataaccacggttctgacaacaaatgccacagtgccggatactcctgcaaagtcggaaactggcccggcccgtaataaatcaggaagatctgcaccagcagcggcgtaccggtaaacagcgtgatataaccccgcaccagccacaccagcaccggcgttttcagcgtcaggatgatggtaaaaatcaatgccagaatcagtgccacaatcagcgaggcaacggttagcgtcaggctggtgtgtagccctttcatcagttcgggtaaatactcaaacattagctgggcctccgctcaaaacgtgtcgcgcgcaggtcaatgcgtttgagaatgtactgactgagcagggtgatcaccaggtaaatcgccgccgccacaatgtaccaggtaaatggttcctgggtacgagtagcgatgctttttgtttgcagcattaaatcattcacactaatcaaactgaccagcgcggtatctttcagcagcaccagccactggttaccgaggccaggcagcgcatgacgccacatctgcggcatcaccagacggaaaaagatagccgatttcgacagccccagcgcctgaccagactcccactgacccaccggcaccgctttcaacgcgccccgaagcgtttgcgaggcataggcggcatacagcagtgacagagcgatgacaccacaaaggaacgggctaacgtcgaagttctcaatgtccatctgcactgggatctgcacgaacccaagattgatagtgaagccatccgaaagcgtcagcagcagctgcgaggagccaaaatagataaacagcaccaccagaatttctggcaggccacgcagaatggttaccagcgctgaacctgcccacgcgacaggacgccattttgccgactcccataccgcaaagaacatcgccagcgccagcccgacaatcaatgcacaaacggcaaggccgacggtcatcccggcggcgcttgctaaaggaaaaaattcattcatcaggaattacttctggaaccatttgttgtagatggtttcgtaagtgccatctttcttcactttttccagcgcagtgttgagtttctgctgcagctcagtgttgccctgacgtaccgcgatgccgaggccagtgccgaagtaatctttatcggtcactttgtcgcccaccgccgccagtttcgggttatctttcagccactcagtgaccactgcggtgtcaccgaagacgccgtcgatacgcccgttttgcagatccagttttgcgttctggtagctgtcatacggaacggtagtgatttccgggtgcttatccataatgaatttctggtgtgtcgtcccgttctgtacgccgacttttttgcctttcagctgatcaacactggtgtatttgccttgctgacccacaaacagggcagagttgtcatagtacggggtggtaaacagcacctgcttttcacgctccggagtgatatccatgcccgccatcacggcttctacgcgacggaatttcaggcttgggatcaggctgtcaaacgcctggttagagaaagtgcaggttgcatcaatctctttacacagcgcttgtgccaggtcgacgtcaaaaccaacgatctggttgtttgcatcaatcgattcaaacggaggataggaggcttcggtagcaaaacgaatggtttcggcagctgtggcggaaagactaaaacctgcaattaacgcggcaatcagaacttttttcattgttgttatcccgaatcttagtgagagagatagtttttaaatgcttcggtttgcggctcggtaaagcagctcgcgtcgccttgttctacgatatgaccattttccatatacaccactcggctggcggttttacgcgccacttcaacttcgtgggtgacgatcacctgggtaatattcgtttctgccagctcacgaatgatgctgacgatttgtgccgtaatttccgggtccagtgcggcggtcggttcatcgaacagcagtacctgcggttccatcatcaacgcacgggcaatagcaacacgctgctgctgaccaccagaaagatgcagcgggtaacgatcgctataaggtttgagacgcagacgttccagcagtttttctgcacgggccagcgcctgatctttactcaaccccagtacacggcagggcgcttcaatcaggttttgctgcacggtcagatgcggccacaggttgtattgctgaaacaccatgccaacgttacgacgcaaatcgcgaatcgctttgtcagagggtgttttggtgaaatcgaaatggttgcctgcaatgttgagcgtaccggagcgcggcatctcaagcagattgagtacacgcagcagcgagcttttacccgcgccgctggggccaagtaacaccagcgtttcgccctgtgggcaatccagcgtgatatcgaacagcgcctgatgcgcgccgtagaagcaattaatgccgtttaattgaatactcattgacactcgtatactggcagtctgatagctattgaggtcgaagatagtacctttgacagaataattatgcaatatttctgctttaaaagttaaaagcaaagcgcattattcaataaacatagcacaaaataacgggggcggtggtcggcgagcataaatgtcggcattcctcacgaaatgccggacaatttacggggtttattggttgatcaaggcgttagcgattctcgatggactgacggagcgtacccgccgtggcatgaacgctaccgcctaagtaacgcacatcgtcgatgacccaacactggccttcctgaatcattaacacttcatcctgccaaccctggtcaccctgtttgagatccacgcgcaatggaatgttacgggcatcacgattagggatagtcgatgcactggcaacgtgggcgctatctggcaaggtggttcgactggagaatggatcgttggtcagtagttcccgatggttattatcccgggaggcatcgctaagcagtgtcgccagtttgtcgctcagataagggcgcaaggcggtgatgtcgttgctgcggtgcaaaatgcggtagtcataaaattgctgggccacgttatccgggcctccttcaacgcaaggaccactgcgtgtgccgttatctttataagctggagtgactgtggtgcaggcactgaggagcagtgcgcaggggataagcattgtcaatttgctgtagcgcataatgatttccttataagcgatcgctctgaaagcgttctacgataataatgatatcctttcaataatagcgtatcagtctgataatgcttttgagatcgaaggcttagcaaacaaggagatcgatcatgcaattttctacaaccccaactctggaaggccagaccatcgttgaatattgcggtgtggtgaccggcgaagcgattttaggtgccaatattttccgtgatttctttgccggtatccgcgatatcgttggcggacgttccggtgcgtatgaaaaagaactgcgtaaagcacgggagatcgcctttgaggaattaggctcccaggcgcgggcgctgggggccgatgccgtcgtcggtattgatatcgactacgaaacggtcgggcaaaacggcagtatgctgatggttagcgtcagcggtacggcggtgaaaacgcgtcgatgagaagattcttctggctggtcgctgccgctctgttattggcagggtgtgcaggcgaaaaaggcattgtcgagaaagagggatatcagcttgatacccgacgccaggcgcaggcggcgtatccgcgcattaaagtgctggtgatccactacaccgcagatgattttgatagctcgctggcgacactgaccgataagcaggtcagctcgcattatctggtccctgcggtaccaccgcgatacaacggtaaaccgcgcatctggcaactggtgccggaacaagaactggcctggcatgcggggattagcgcctggcgcggggcaacgcgccttaacgacacctctattggcattgagctggaaaaccgtggctggcaaaaatcggccggagtgaaatattttgccccgtttgaaccggcacagattcaggcgcttattccactggcgaaagatattattgcccgttatcacatcaagccggaaaacgtagtggcacatgcggatatcgcaccgcagcgcaaagacgatccggggccattatttccctggcagcaactggcgcagcaggggattggtgcctggccggatgcgcagcgggttaacttttaccttgccgggcgcgcgccgcacacaccggtagataccgcgtcattgctggagcttttggcgcgctacggttatgacgttaaacctgatatgacaccgcgcgagcagcggcgcgtgattatggcattccagatgcatttccgcccgacgttatataacggcgaagcggatgcagaaactcaggcgattgccgaagcattgctggagaaatacgggcaggattagcgcggcagttttccgtggtcgcgtagccaggcggcagttttctcgataccttcatccagggtgatgaccggctgataacctaactcttcctgcgcacgcgtaatatccagcgtaaagtcaaaattcaacttggagacgccgtagtgggtcagcggcggctcttttgctgacttgcggcctaaacgctccatgctgcgggcgatcatatccagcatcgggtaggggacggaacgaatacgacagtcaatattcaactcgtcgatcagcttctgcacgatgctgcgcagtgtgcgatgctcgccgttggtgatgttgtacacacgcccggaaggtagcttatcgcaggcttcctggcttgccagccacattgcgtgcacggcattttcatagtaggtcatatcgaccagcgcactgccgccatgcggtaacagaatactgccgtagtggtgcatcatatgcgccagacggggaataaagactttatcgtgcggtccgaacagactttgtgggcgcagaatagtaaagcgcgtttgtggattcgcctgcgaaagcatattgatcacttcttcgctggctgctttgctgcgggcaaactcgttggcgaagcggtgagggcgaaaatcttctttaatatcgcgatggtggtgataatcgaagtacagggagggggaagagatatgaataaagttacgcacaccccaggcgacagcccattcacccaggcggcgagtggcgcgaacgttagccagatcgaaagcctgttgtgtcccccagggtgaggtaaagctggagcagtgccacagcgtatcaatgcccgcgagcatcactttagcttgtgatgaaaccagctcggtcagatccgccggaacaaactctgcgcccattttttccagcaatttgcccattgcctcgttgcgaccggtcgctcgcacgctgatgcctttctggcataaaaactctaccgcgtttcgacctaagccgctggtggcgccggtaaccagtaccttcatatcaatccactgttgttgagaaaataacgtgcgcattcttccgtgatttcccccatgatgcaatgggaaacatgaaagaataacgcaggttttgtcgattaatctgtgctttgttctgccagtctggcgatttgttttgccattccgcgaaaaataaacagatgcgcggggatcatcaataaccagtaaaacagccccggcataccgtgcggatgccagaaagcgcggacatcgatagtacgatagtcgcctttatcttccaggctaaaacacagtcgtcccagccccggcgctttcatgccaaataacaacgtaagttgtttttccggttcaacgacaatcactttccagctatccaccgcatcgccagtctgtaaatattcgcgctccgggcggcctttcgccagcttatgaccgatcgcgcggtccatcaacgcccgtgtctgccacaaaatattgccaaagaaataacgctctttaccgccgatttggttcactacctgccataaagcagcaaggctggcggacgttttaacggtaaaccccgcctgtttggcaaaataaccgtactccggtcgccagcgggcaaaggcctgagcgtcgtagccccagtcgctggagttgaccagtttttcctcctctttcaacgtgctacgtaccgcgtcatcgaaagcgatcagccgttgtgggatgagtgcacgtagcgcggtatcatccgccagcagatcgtgtttcagcccctgaatcaacgccctggcggtggtgggcggtacggaagtaatcacattgagaaaccacaccgaaatccagcgggtggggagggggatggggatcaaccagcggcgcttaccgctcaccgccataaaatgttcaaactgttgctgataactgagcacctctggtccggcggcttcgaagatgcggtgttcgctggccggatgatctaacaacgcaaccagatagtgcagcaagttttccagcgcaatgggcgtggtgcgtgaacgaacccagcgcggaggcgttaagactggcaggttgtagaccatatcgcgcatgacttcgaacgccgcggaacctgcgccaacgataattccggcccgcagttcggtcacgggtacattcgcttcacgcagaatgtccgccgtagcctgacgagcacgcagatgatccgactgctcatgtggcggggcctgcaacgaactaagaaagattaattgcttaactggtacttcacgtagcgcatcgcggacgttgagagccacctggcgctcctgagcgataaaatcgccgccttcgcccatgctgtgcaccagaaaatagaccgtatcgatatcctgcaacagggccggtaggttatccggccagctgagatcgactttatggcaactgacgtttgccagttgcagctttgcaagcctgtcgacatgacgtgccgccgccaggatctgatgcccttgctggctgagtgtgcgcaccagatgctgaccaatgtagccactggcaccgagaactaaaatgcgttgcggcacgtctctctccttaacgcgccaggaatgcacgccagtgggcggcgacttccgccagttgttcgcgcgagacgtcaagatgcgtcaccaggcggacaatcggcgaggcgttaatcagcacgtttctcgctttcatgtattcgcctaacgcggcagcattttcttccccgacgcgaacaaacagcatattggtgtcctgacgcatcacatccgcgcctgcttcacgcagctgctccgccatccaggcagcgttgtcgtggtcttcctgcaagcgcgcaacgttatttttcagggcatatatcccggcggcagccagaatgccggactggcgcatcccgccacctgtcattttccgccagcgaatggcacgtttaatgtaatcacgattaccgacgagtaatgaaccgactggcgtcccaagacctttcgacaggcaaatggtgaacgaatcacaatattgcgtgatctctttcagttcgcagccgtaagccaccacggcattaaagatgcgcgcaccgtcaacatgcagcgccagattgcgctcgcgggtaaattcccatgcttctttcaggtattcccgcggcaacactttgccgttgtgggtgttttccagactgagtaatttggtgcgggcgaaatggatatcgtcgggtttgattttcatcgccactttatccagcggtagcgtgccgtcggcagccgcgtctatgggttgcggttgaatactgcccagcaccgccgcgccaccggcttcaaacagatagttatgcgcggcctgaccgacaatatactcttcgccgcgttcgcagtgactgagcagagcgaccaggttggcctgagtgccggtaggcagaaaaatggcggcttctttaccggaaagctctgctgcgtagtcctgcagagcattaacggtagggtcgtctccgtaaacgtcgtccccaaccggggcggccatcatcgcttcgagcatggcgcggcttggtcgggtaacggtatcactgcgtaaatcaatcatggcatgtccttattatgacgggaaatgccaccctttttaccttagccagtttgttttcgccagttcgatcacttcatcaccgcgtccgctgatgattgcgcgcagcatatacaggctgaaacctttggcctgttcgagtttgatctgcggtggaatggctaactcttctttggcgaccaccacatccaccaacaccggaccgtcgatggagaaggcgcgttgcagggcttcatcaacttcagacgctttttctacacggatacccgtaatgccgcacgcttcggcaatgcgggcaaagtttgtgtcgtgtagttcggtgccgtcagtcaaatagccaccagctttcatctccatcgccacaaagcccagcacgctgttgttaaagacgacaattttcactggcagtttcatctgcactactgagaggaaatcgcccatcaacatgctaaaaccgccatcgccgcacatggcgaccacctgacgttctggctctgtcgcctgcgcacccagcgcctgcggcatggcgttagccatcgaaccgtggttaaacgaacctaacaggcgacgcttgccgttcatttttagataacgtgccgcccacaccgttggcgtaccaacgtcacaggtgaaaatagcgtcatcggcggcaaaatgactaatttgctgcgccagatattgcgggtgaatggctttctcgctcggtttagctaaatcgtccagccctttgcgggcgtcgcggtaatcttccagcgctttatccagaaacttgcgatcggctttttcttccaccaatggaagcaatgcacgcagagtcgacttgatatcgccgaccagtgccatatccaccttgctgtgagcgccgatgctggctgggttgatatcaatctgaatgattttggcatcggtcgggtagaaggcgcggtagggaaattgcgtgccgagtagcactaacgtgtcggcgttcatcatggtatggaaacctgacgagaagccgattaacccggtcattccaacatcatacggattatcgtattcgacatgttctttaccgcgcagggcatgaacaataggcgctttaattttcccggcaaactcaactaactctttatgcgcccccgcgcagccgctgccacacatcagggcgatattgctggaataacgcagcagttgcgccagtttgcgtaactcttcttcttccggcgtcacgactggttgtggcgcatgataccagtgcatggttgccccttctggcgcaggttttaacgccacgtcgcctggtaacacgacaaccgaaacgccacggttaagcaccgctttgcgcatggcaatcgccagtacttgtgggatctgctccgggctggaaaccagctcgcaatagtgactacattcgcggaatagctcttgtgggtgggtttcctggaaatagccgctgccaatttcgctggagggaatatgagcggcaatcgccagtaccggaacgtgattgcggtggcaatcgaacaggccgttgattaagtgcaggttgccggggccgcacgatccggcgcagaccgccagttctccgctaagttgtgcttcagcgccagcggcaaaggccgccacttcttcgtggcgggtggacatccactcgatggtgcccatgcgattaagactgtcactaagaccgttcagagagtcgcctgtgactccccagatgcgtttcacccctgccgattcgagtgttttggcgatataagctgcaaccgtttgtttcatggttctccatctcctgaatgtgataacggtaacaagtttagttcatctgacggagggggaagggatgggagagaaaggaggcactaacggttaaatagcccgatgaaaggaatatcatcgggcataaggcgattatgcgagaaccaaatccccctgcggatggcaggagcaggccagtacgtaaccttcagcgatttcggcgtcggtcagcgtcattgtgctgctcaccgtatattcaccggaaaccacttttgtcttacagcagccgcaaacacccgcacggcaggcagcgacaaccggaacgttattgctttccagcgcctccagtagcgtggtgccaaccggggcgtaaaattctcgtgccggttgcagtttggtgaatttcagaccgctggtcgccgcttctgctactggggtgaagaatttctctttaaagaaacgcgtcacgccgagcgctttcacttcctgctctacccaatccatatacggagccgggccgcaggtcatcacggtacgtgaagctaagtcaggtacacctgccagcagttcgcgagtgagacgaccagcgataaagccttcggtaacgttattttctgccaccagcgttaccggatagttacgccactcatcggcgaaaataacatcctgcggcgtacgcacgttgtagatcacccgcacatcggcctgtggacggttcttcgcaagccagcgacgcatcgacataatcggcgtgacgccgcagcctgccgccagcaacaggaatttatcttctgctttatcgtcgcaggtaaattcccccatcgcgtccgaaagccagagataatcaccgcgttttacatcgcgcgtcagccactgggagccgacaccgtcatcaatccgccgcacggtcagggtgatatattcactcacgcctggcgtggaggaaatggtgtaagcacgcagcgtttccgctgagtttcgcacgctgaccagtgcatattgcccggcgcgatatgggtagtaatcgtggcaaatcagggaaatcgtccacacatccggcgtttcttgcgtaatgtgatgaacctgcatccgccacgggcattgattcgttggcatcgtcatcgacaaactccttacgcgctcaacagttgcttcatgtcttcttcaacagtggtgatagaacgcaggccgaatttctcgttcagcaccgccagcaggtctggtgtcaggaaaccaggtgcagtcgggccggtgacgatatttttcacgcccagagaaagcagcgtcagcagaatgacgatcgctttctgttcaaaccaggagagcaccagcgacagcggcagatcgttgacaccgcagcccagtttctctgccagagtgacagccagaataatcgctgagtaagcatcgttacattgacctgcatctaccagacgcggcagaccttcgatatcgccaaactcaagtttgttaaagcgatatttaccacaggcgagggtcaggatcaggcagtcatccggcacgctggtggcgaaatcggtgaagtagtggcgctcgccgcgtgcgccgtcacagccaccaagcaggaagatatgacgcagtttttcacggctcaccagatcaatcagcgtatcagcagcgccaagcagcgtctggcgaccaaaacccacggtgataaggtgcggaatttcgctgtacgggaagcctgccatctgttgcgcctgggtgataaccgcagagaaatcatcaccgtccagatgacgcacgccaggccagccaacaatgctgcgggtccagatacgatcgtcataagcgcctacggttgggtcgatgatgcagttcgaggtcatcacgatggggccagggaaacgagcgaactccacttgctgattctgccagccgctgccgtagttaccgaccagatgcttgaatttacgcagctccgggtagccatgcgcaggcagcatttcgccgtgggtgtagacattaacgcccgtgccttcggtctgttccagcaggttgtagagatctttgagatcgtgaccggaaatcagaatgcatttacccgccgtcgctttgacgttgacctgggttggcgtcgggtgaccgtatttaccggtttcgcctgcatccagaatgctcatcactttgaagttcatctggccgatttccattgaacactcaagaagcgcgttcatatcggcaggccaggtccccagccacgccatgattttatggtactgggcataaatatcgttgtcgtattgaccgagaacatgcgcgtgttccatataggccgccgcacctttcaggccatacaggcacagcagacgcaggccgagaatgttttcgccaatcgccgctttatctttgttaggggtaaattctgctgcctgacgttgcagctcgccgagatcgtcgctcaccagttgcaggtcagccatcgggttatcgacgcgcgcgttggcatctacagccaggcattgcgctttcagcgcctcgcgcagggcaatcgcttcacgagcgtagccgacaatacgcggagaatcgaagttaacgttggtcagggttgagaaaaaggcacgtggcgcgaagctgtcaacatcgtggttgatgatgccgtattcacgcgcttttaccgcccaggcagaaagcccttgcagcgccgcgatgagtaaatcctgaaggtcagaagtttccgccgttttaccacacatcccctgcgcgtatgagcagccgtttcctgccggagtacggatagtttgttcacattgcacacaaaacatgatcacaccttttaaagttatatttaatatacatgtttaaggttaagacgcttaacgcggggataaaagggatttttcatgcaactttaagggagattgatttagcgcaattttggcggcagggatctaccgccagagaggtattacgcagagaaaaaggcgatgaggatcggcactaacaggctaagaataaaaccgtgaacaattgccgccgggaccatatccagcccgccagtacgttgaagaacgggcagggtgaaatccattgatgtggcaccgcataagcccagtgcagtagagcggctgcggcgaatcagcccagggatcaacataatagcaatcagttcacgggccagatcattaaaaaacgccgcgctcccgattaccggaccaaaagattcggtcaataaaataccggaaagagaataccagccgaaaccggaggccattgccagcgcggtattgatggggagatcaagaataaaggcgttaattaaaccaccaattaatgaactgacaaccaccaccacggcgacaatcattccccggcgattaaggacaatctgctttaaggtcatgccattattgcgcaactgaataccaacgaggaaaagtagcaaaattaacgtgtattcactggcttcggtcgcgtgttgtaagaaagccagtccacttagaccaatggcaaaaccaatcactactacgccgcacagttttagcgactccagcgccatcgcaatacgcgacgggagtttttcttgctgatggtggttgcgccacggcaggcctcgctccagccacatcagggcggcaatattacacagtaaaataacggtaatactgacggcagaataatgcagaatcgccaacaggttactggcgaggttatcgagaaacgccagactgatacccataaaaaagagaataaggtaaaccatccagcttaatagctgattaataacttttaacgcagcttgttggcgaagcggaatgaggtaacccacaatcaggggaaccagaatgattaacagcccagaaaacatgaaaacccagtccttgcaaagatgaagtcgaaatgcgcgatgacacactactgaaagcggaaggacgagtaaagttgcaattaaaaggaaatgttatgcataaggagcagtagagtattcgttttcatttaaagatattcttgcgctttaattacaaactgcaccgatgttggtggcgtcaaaatcgccgaggcgttccctgaaggccggggcagcccacatggatgtgggctgagggcgcgttttacagggatgttacctcgcgcccgacccggtagccgtaagggataagtcgagggcaccgcgcagcggcgattttgttcgccagagcccgggggtgcagggggcggcggcgattggccgccccctgcgcgctccttgcgccagtggcaatatgttgcttagctcatgaaaggagcgcaacaagatgatgaatcaacatataacaacatcttaaaaaaaggcctgacattacgccaggccttctgcgttaattaatcacgcttttccagcagggtccggtaaatcagaccaccgataatgccgccgacaattggcaccacccagaagaaccacagttgttctaatgcccagccgccctggaagatagcaaccgcggtgctgcgcgccgggttaacagaagtgttagtcaccggaatactaattaagtgaatcagggttaaggccagaccaatagcgatcggcgcaaaacctgccggcgcgaatttgtcggttgcgccgtggatcaccaacaggaaacctgcactcaataccagttcaactaccagcgcggaaagcatggaataaccgcctggtgaatgctcgccataaccgttagaagcaaaaccgctggctgccgcgtcaaaacccgttttaccactggcaattaaatacagcagcgccgctgcaacaataccgccgacaacctgggcaattacgtagccaacgacttcttttgccggaaaacgtccgccagcccataaaccaatagtgaccgccgggttaaaatgaccaccagaaatatgaccaacagcaaaggccatcgtcagaacggtcagaccgaacgccaacgccacgccggcaaaaccaatgcctaattccgggaagcctgcggccagtacagcactaccacagccaccaaaaacaagccagaaagtaccaaaacattcagctgctaattttctgaacatatccaccacaattaaaaattgaccctgtgaaaaatatggtcgttttatagggtcgtcgtaaaaaagtgacgacggaaataatgcgcggctattttaaaaacgaaggcgagtcattcaccagataaataaatccagtaaatttgatttagggcaacagcgggttgccccatatagtcatttgtctgattgacagtgtagtgcacgcaaaagatttaatcctttaggcgtaataaaaaataatttatcatgctaattatttgattttgttgtttttgcagacttatcagcaagagggagtataacgcgattattcgctcatttttcagacatttgccatgcttaaatgtgatgtcatcacgtattagcaaggcctttcccgttatactgccagcgtaaaggataagtcacatatttctggaggggatatgattcttgagcgcgttgaaattgtgggttttcgcggtatcaaccgtttgtcgttgatgctggaacaaaacaacgtcctgattggggagaacgcgtggggtaaatccagcttgctggacgccttaactctgctgctatcgccagaatcagatctctaccattttgagcgcgacgatttctggttcccgccgggagatatcaacgggcgagaacatcatctgcatattattttgaccttccgcgaatcgctgccaggccgacatcgggttcgccgttatcggccgctggaagcgtgctggacgccatgcaccgatggctatcaccgtattttttatcgtctggaaggggagagtgcggaagacggcagcgtgatgacactgcgcagttttctcgataaagacggacatccgattgatgtcgaggatattaacgatcaggcacgccatctggtgcgtttaatgccggtgctgcgcttgcgtgatgcccgttttatgcgccgtattcgtaacggcacggtgccaaatgtccctaatgtggaagtcaccgcgcgccagctcgatttcctcgcccgtgagttatcctcacatccgcaaaatctctctgatgggcagattcgtcagggactttccgcaatggtacagctgcttgagcattatttctctgagcagggggccggacaggcgcgatatcgtttaatgcggcggcgagccagcaatgagcaacgaagctggcgctatctggatatcatcaaccggatgattgaccgacctggtgggcgctcgtatcgggttattttgctcggcctatttgctactttgttgcaggcaaaaggcacattgcgactggataaagacgcccgtccattgttgctgatcgaagatccagaaacccgtttacaccccattatgctttcagttgcctggcatctgttgaatcttctgccattgcagcgcattgccaccaccaactcgggtgagttgctttcgttaacgccggtagagcatgtttgccgactggtacgtgagtcctcgcgcgttgccgcctggcgtctggggccgagtggcttgagtaccgaagatagccgacgcatatcctttcacattcgttttaaccgtccgtcatcgctgtttgcacgctgctggttgctggtggaaggggaaacggaaacctgggttatcaatgaactggcgcgtcagtgcggacatcattttgatgccgaagggatcaaggtcattgagtttgcccagtccgggctaaagccactggttaaatttgcccgccgaatggggattgaatggcatgtactggtcgatggcgatgaagcagggaagaaatatgccgctacggtacgcagcctgttgaataacgatcgggaagccgaacgagaacatttaacggcgttaccggcgctggatatggaacattttatgtatcgccagggattttccgatgtgttccaccgcatggcgcaaatcccggaaaatgtaccgatgaatctacgcaaaattatctcgaaagcgatccatcgctcttccaaacccgatcttgccattgaagtggcaatggaggcaggacgtcgtggtgtggactccgtaccgacgctgctgaaaaaaatgttctcacgcgtgctgtggctggcgcgcggtcgcgcggattaaccgcgaaacatcgtggccatttgtggctgaatagcgtcgagcatctcatagcgccgacggtattcagcccgttttttactggcgatttcggcaatctcttttcgtgctatctgtgctggaaggcggtaatggcgttcagcatcacatacgccgccaaccgattcccagaaagcgttgtaatcagcgtggatcttgccttctttatcgcgataacgcaggctgcggtaaatatgcgtttcattgctgacggcaataatctgctctacctgcaaacgttgggcaaacagacaggccgcttccatcacgaggcgtttgggaaatagcccgtggcaggctttcgtcgcattctggatttcctgatgtggaatttcccattttgcgccttgcagtccgccaataaacatcgttcttttcccctgatattcacacagggtaaacgtgatctctgccagaggaataccttcgctgttgcggaacaggattgtgctgtcaccttctttatccattgagatcatcatggtcagctcaagcgtgaactgctcgccgtttttgccttccagcttcgccagttgcagcccgggggtattcaaatataagctgaattcttccgccgacatacattcgcggagtaacgcataatggtaacgtaacgcctccagcaattgcttacggctaagattcgccgcaaggtaagggcgatgcagacgcacaggcagtcgcggctggcgcgttaacaatacattgagattaggccagtgggaaagttcgttcatccactcaacgcttaaacgcggcataatcaacgagcgcagcaaaaatttctggcgaaaactacggcgatgccagaatttacccggccgacactgtccacgtgccagactaagaaaaagtgacaggctgctgagagattcagatggcgtaaaggtccgttcagttagctgcgacatattcatgaaatcaatggttatacatggcgtcgatttcaccattgcgtatcttaaccaaacatcaatagtgtgattactaacgtaaattttagggttttgttgatatttcgttgaagttaatgacccggattggcatatggagtattcagaaaatttatgaaaaagcggaaaaccgtgaagaagcgttacgttattgcgctggtgatagtcatcgccggactgattacgttatggagaattcttaacgcacccgtgccgacttatcagacgctgattgtgcgccccggtgatttacagcaaagcgtgctggcgaccggaaagctggacgcgctgcgtaaggttgatgtgggcgcgcaggtcagcggtcagttgaaaactctgtcggtggcgattggcgataaagtaaaaaaagaccagcttttaggggttattgatcctgaacaggctgaaaaccagattaaggaggtcgaagcaacgctgatggagctacgtgcgcagcggcagcaggcggaagcggagctgaaactggcgcgggtgacgtattcccgtcagcaacgtctggcacaaacgaaggctgtttcacagcaggatctcgacaccgccgcgacggagatggctgtgaaacaggcgcaaattggcaccattgacgcgcaaatcaagcgcaatcaggcttctctcgatacggctaaaaccaatctcgattacactcgcatcgttgccccgatggccggggaagtcacgcaaatcaccactctgcaaggccagacggtgattgccgcacaacaagcaccgaacattctgacgctggcagatatgagcgccatgctggtaaaagcgcaggtttctgaagcggatgtaatccacctgaagccggggcaaaaagcctggtttacggtgcttggcgatccactgacgcgctacgaggggcaaatcaaggatgtactaccgacgccggaaaaggttaacgacgctattttctattacgcccgttttgaagtccccaaccccaatggtttgctgcggctggatatgactgcgcaagtgcatattcagctcaccgatgtgaaaaatgtgctgacgatccctctgtcggcgttaggcgatccggttggcgataatcgttataaagtcaaattgttgcgtaatggtgaaacacgcgagcgtgaagtgacgattggcgcacgtaacgataccgatgttgagattgtcaaagggcttgaagcgggcgatgaagtggtgattggtgaggccaaaccaggagctgcacaatgacgcctttgctcgaattaaaggatattcgtcgcagctatcctgccggtgatgagcaggttgaggtgctgaagggcatcagcctcgatatttatgcgggtgagatggtcgcgattgttggcgcttcgggttccggtaaatcgaccctgatgaatattctcggctgtctggataaggccaccagcggcacctatcgcgtcgccggtcaggatgttgccacgctggacgccgatgcgctggcgcaactgcgccgcgagcatttcggctttattttccagcgttaccatttgctttcgcatttaaccgccgagcagaacgttgaagtacccgccgtctatgctggtcttgagcggaaacagcgactgcttcgtgcccaggagttgctgcaacggctggggctggaagaccgtacagagtattatccggcacagctttcgggtggtcagcaacagcgcgtcagcatcgcgcgggcattgatgaacggtggtcaggtaattcttgccgatgaaccaaccggcgcactggacagccattctggcgaagaggtgatggcgatcctgcatcagctgcgcgatcgtgggcatacggtgattatcgtcacccacgatccgcaggtcgctgctcaggccgagcgggtgatcgaaattcgcgacggcgaaattgtgcgcaatcctcccgccattgaaaaagtgaatgttactggcgggacggaacctgttgtcaacacggtgtctggctggcggcagtttgtcagcggttttaacgaggcgctgacgatggcatggcgggcgctggcagcgaataaaatgcgtactttactgaccatgctggggattattatcggtattgcgtcggtggtttccattgtcgtggtgggtgacgccgccaaacaaatggtgctggcggatattcgttctattggtacgaatactattgatgtctatcccgggaaagattttggcgatgacgatccgcaatatcagcaggcgctgaagtacgacgacttaatcgccatccaaaaacaaccgtgggtcgcctcagccacacctgccgtctcgcaaaacctgcgcctgcgttataacaatgttgatgttgctgccagtgccaatggcgtgagcggcgattattttaatgtctatggcatgaccttcagtgaaggaaacacctttaatcaggagcagctgaacggtcgtgcgcaggtcgtggttctcgacagtaatactcgccgccagcttttcccccataaagcagatgtggttggcgaggtgattctggtcggcaatatgcccgccagagtcattggtgtggcggaagaaaaacagtcgatgtttggtagcagtaaagtgctgcgtgtctggctaccttacagcacgatgtccgggcgagttatgggccagtcgtggcttaactccattactgtcagggtgaaagaaggatttgacagcgccgaggcggaacagcaactcacgcgtttactttcactgcgccacggaaagaaggatttctttacctggaacatggacggcgtcttgaaaactgttgaaaagaccacacgtactttacaactgtttctgacgctggtggcggtgatttcgctggtggtgggcggtattggtgtaatgaatattatgctggtgtcagtgaccgagcggacgcgggaaattggcattcgcatggctgtaggtgcgcgagcaagcgatgttttgcaacagttcctgatcgaagccgtactggtttgcctggtcggtggcgcgttgggaataacactgtcactgttaattgctttcaccttgcagcttttcttacccggctgggagattggtttttcaccgttggcgctgctgctggcgtttctctgctcgacggtcaccgggattttatttggctggttacccgcacgaaatgcggcacgactggatccagtagatgctctggcacgagagtaatttttgagataaaaatgccagccgatcgggctggcattttgcctttaggatgtacacaatgagacagaagagctatgcgactgccgcttctacttcgacgggcacaataacactggcgtgattgccttttggcccctggtggacatcaaactgaacggattgtccagcttttagcgttctgtaaccatccatctgaatggtggaataatgagcgaaaatatcttcgccgccgccttcagggcagatgaaaccaaaccctttggcattgttgaaccacttaacagtacccttttccatgcttcgacatccttcgcaaatcttatacaagtaagatggaataaaccggggtcagagagggggctgttcaaaacctcgccaactctagaaatacaatttagagaattagggcgagccgtcaagcatttgacaggggacaaggggcaggtatgaatcaaaaatttgaagcagttaacgctattgacaggaatgtgacagatgtcgctgatgccaacgatagatgatagttatctatcatgtggagtagattggtcaggcaaataagctcttgtcagcggcagggcgttctgccgataaccgtaaccgaagatgataactgacaatgggtaaaacgaacgactggctggactttgatcaactggcggaagaaaaagttcgcgacgcgctaaaaccgccatctatgtataaagtgatattagtcaatgatgattacactccgatggagtttgttattgacgtgttacaaaaattcttttcttatgatgtagaacgtgcaacgcaattgatgctcgctgttcactaccaggggaaggccatttgcggagtctttaccgccgaggttgcagaaaccaaagtggcgatggtgaacaagtacgcgagggagaatgagcatccattgctgtgtacgctagaaaaagcctgaatgcaggcataaaaattgggggaggtgcctatgctcaatcaagaactggaactcagtttaaatatggctttcgccagagcgcgcgagcaccgtcatgagtttatgaccgtcgagcacttgttactggcgctgctcagtaacccatctgcccgggaggcgctggaagcgtgttctgtggatttggttgcgctccgtcaggaactggaagcctttattgaacaaaccacacccgttctgcctgccagtgaagaggagcgcgacacacagccgacgctgagttttcagcgtgtactgcaacgtgcggtcttccatgtccagtcctccggtcgcaatgaggttaccggtgcaaacgttctggtcgctatctttagcgaacaggagtcgcaggcggcatatctgttgcgtaaacatgaagtcagccgtctcgatgtggtgaactttatctctcatggcacgcgtaaagacgagccgacacagtcttctgatcctggcagccagccaaacagcgaagaacaagctggtggggaggaacgtatggagaatttcacgacgaacctgaatcagcttgcgcgcgtgggcggaatcgacccactgattggtcgtgagaaggagctggagcgtgctattcaggttctctgccgtcgccgtaaaaacaacccgctgctggtgggggaatctggtgtcggtaaaaccgcgattgcggaaggtcttgcctggcgaattgttcagggcgatgtgccggaagtgatggctgactgtacgatttactctctcgatatcggttctctgttagcgggcacaaaatatcgcggcgactttgaaaaacgttttaaagcgttgctcaagcagctggagcaggacactaacagcatcctgtttattgatgagatccacaccattatcggtgcgggtgcagcgtctggtggtcaggtcgatgcggctaacctaatcaaaccgttgctctccagcggtaaaattcgtgtaattggttcgacaacctatcaggagttcagcaacattttcgagaaagaccgtgctctggcgcgtcgcttccagaaaattgatattactgaaccgtcgatcgaagaaactgttcaaatcatcaatggcctgaaaccgaagtatgaagcgcaccacgacgtgcgttataccgcaaaagcggtgcgtgcggcggtagagctggcggtgaaatacattaacgatcgtcatctgccggataaagccattgatgttatcgacgaagcgggcgctcgcgcacgcctgatgccggtaagcaaacgcaagaaaaccgttaatgtggcggatattgagtccgtggtggcccgtattgcacgcattccagagaagagtgtttctcagagtgatcgtgataccctgaaaaacctcggcgatcgcttgaaaatgctggtcttcggtcaggataaagccattgaggcgctgactgaagccattaagatggcgcgtgcaggtttaggtcacgaacataaaccggttggttcgttcctgtttgccggccctaccggggtcgggaaaacagaggtgacggtacagctttcgaaagctttgggcattgagcttctgcgctttgatatgtccgagtatatggaacgccataccgtcagccgtcttattggtgcgcctccgggatacgttggttttgatcagggcggtttgctgactgatgcggtcatcaagcatccacatgcggtgctgctgctggacgaaatcgagaaagcgcacccggacgtgttcaatattctgttgcaggtgatggataacggtacgctgaccgataacaacggacgcaaagcagacttccgtaacgtggtgctggtgatgaccaccaacgccggggtacgggaaactgagcgcaaatccattggtcttatccaccaggataacagcaccgatgcgatggaagagatcaagaagatctttacaccggaattccgtaaccgtctcgacaacattatctggtttgatcatctgtcaaccgacgtgatccatcaggtggtggataaattcatcgtcgagttgcaggttcagctggatcagaaaggtgtttctctggaagtgagccaggaagcgcgtaactggctggccgagaaaggttacgaccgggcaatgggcgctcgtccgatggcgcgtgtcatccaggacaacctgaaaaaaccgctcgccaacgaactgctgtttggttcgctggtggacggcggtcaggtcaccgtcgcgctggataaagagaaaaatgagctgacttacggattccagagtgcacaaaagcacaaggcggaagcagcgcattaatctgattgttaggtaggttggtcaagtccgtaatctcgaaagaggttacggactttttgtttatggggtggaggaggttcagaccctttttttaatgatgatggtaagttgttgataattagtgctgcgggaaggtaaggataaaaaagggtgctgcaggagaatgggatggttttgctttattaacaacgggctaaacgtgtagtatttgagttcactgccgtacaggcagcttagaaattcacaggtaacatactccacccgcccaccatgttcactgccgtacagacagataaaatgcgaaaaaaaagctcgcactttcgtacgagctcttctttaaatatggcggtgagggggggattcgaacccccgatacgttgccgtatacacactttccaggcgtgctccttcagccactcggacacctcaccaaattgttttgctaccaaacctcatgggtggcaacggggcgctactatagggagttggagtaaaacggtcaagaagaattttaatgataattattgtttgctcatactgtaaacaagttgtgcagtatatctacatcgagacaagttacggacttatacttccaaagtacttcatacatatcacaaaataaaaaggccggttaaaccgaccttttactcgttctttctcttcgcccatcaggcggtaaaacaatcagcgactacggaagacaatgcggcctttgctcaggtcgtacggggtcagttcaacagtcactttgtcgcccgtcaggatgcggatgtagtttttgcgcattttaccggagatgtgtgcagtaaccacgtgaccgttttctaactctacgcggaacatggtattaggcaacgtttcaagaacggtaccttgcatttcaatattgtcttctttggccatctaatcctctggggtatcactaccgtaatttgaaccggcaagataatgccgaagttctgtaaataagtaaagatttgcgcgctaaatcgcaacaaacaggttcggcacattactccgaaaacacacggctaagccgcaccaaaagcgcaacgtataagggagcggtgagataaacgatgggcgttacctgacgcgaaaaattccttatcggcagcggggtaatgagcgtaaccaactctgcgaccgcaattataacactctggggagaaatgtgccgaaaacattcattcttgtggtgaaaacaagcatcgtggtacccagaaattattcggcaatcgtccgaggcgcatttgattgagataattaaggtaatcccggcggggaatttcgcaggcaccaagcgatgctgtgtgatcgttaaggacctggcagtcgataagcttaccgccatgaccgataaattcctcacagaataccagaagcgccgttttagacgcattttccatccggctgaacatggactcgccacaaaatagcgttccctgggccacgccgtacataccgccgacaagctcatcttcacgccagacttcaatggagtgggcatggccgagttcgtgaaggcgatggtaggcttcgaccacgccacgcgtgatccaggttccttcttcgcgatcgctggcacagccttcaatgacctgaccaaaagcgtaattcatcgtgacacgatagggcgagcgtttatgaaatcgcttcatactacggctgatatgcagtgattctggccatagcaccgcgcggggatcgggcgaccaccagaggatggggtcgcctggagaaaaccacggaaaaataccacgctggtaagccattaacaggcgcgcagggctaagatcgcccccaagtgccagcaggccgttaggctcacgtaatgcgccttccggggaagggaaggctattgaatggcgagaaagctgaaccaggcgcatgaccgcaaaactccacgcaagtcggatcgttcaataatagcttacaaaccctgcttgaactggtaataacgcccctgtctggcaagcagttctgcgtgagtaccttgctcaataatttgcccgttgtccatcactattatttgttggaaacgagagagtccgcgaagtcgatgggtgaccattaacaccgttttctcacgcatcatttctgcaagcaattcaaggatctggctttcggttgtggcatctaagccttcggtaggttcatccagcaacaccagtggcgcatcatgtaacagcgcacgggcgatagccagacggcgcagttcaccaccggagagctggcgtccgccttcacctaaccaactgttgagacctgcatcctcgagcagcttttccaggccaacgcgacgcaagatctccgacagagcctcatcactactgccaggcgaggcgagtaaaagattatcacgcagcgtggcgctaaacagatgcactcgctgaggaacaacgctgatggtctgtcgtagagccgcttcattcaggctggctatggggctatcgttaagcaaaatctcgccctgttgcgggtcccatgcgcgggtcagctgttgtaacagtgttgatttgccgcatccggttcgcccgagaatcgctatatgttccccggcgtttacctgaagagaaatccctttaagtgcctgttgagattgctccggataagtgaactgaacatcccgtaacgtcagcgaaacgcgatcggcaacacgagtttgggtatcaggaaaggtgacctccggtttttgatccgttaagtcagagatacgtacggcagaggcaatgacttgccccagatgctgaaatgcacccgttactggtgccagtgcttcaaacgcggctaacgcgcagaagacaaacagggcaattaacgcgccgggttgagcattgccgccaacgccgccagacgccatccacagcatcaggatcaccgctaacgcgccaatgagcagcattatcgcttgcgacaatgcggtcagttcagattgacggcgttgcgcttccagccattgaatttctgtattctctagttgcgtgcgataacgatcgctggcaccaaaaatggtcagctcagcttgcccttgcagccaggccgtcagttgttggcgatactgtccgcgaagatgagtcagattttgcccggtgctttttcccgcacgataaaacagcggtggcatcaggaaaagcgtcagtaacataatgccgcccagcgtaaaggcgagggtgaaatcaaggaaacttaacccgattgtcaccaccataatcaccacaaaagcgcccaccagcggcgagataacgcgcaggtaaagatgatcgagcgtatcaacatccgccaccacgcgattgagcaattcgccctgacgatagcgcgccagtccggcaggggagaggggcagcaatttgctgaaggtgtaaatgcgcagatgctgcaacacgcggaaagtcgcgtcgtgacttaccagacgttcaaaatagcgcccggcagtacgggtgattgctgcgccacgcacgcccgcagcgggtagcatatagttgaagctgtacagtccggcaacccccgcaaccgctgaggccgagaggaaccagccggaaagtgtcaacagaccgatactggcgagcagcgtcacaattgccagcacaataccaagacttaacatccatttatgacgtttatacagtgccagatagggtagcaaagcgcgcatttaaatctcctcctgacgatgggccagtaatgtggcgaatgggccaccagccacacttaattccgcgtaacgtccttgctcaataatccggccatcctgcataacccaaatgacatcccagtcagcaagatcttctaactggtgggtgaccattaacgttgtctggcgcagagaggcggcattcagcgcctccattacgcgctgttcactgtgagcatcaaggctggcagcgggttcatccaacagtaatagcgaacagggatttagtaacgcacgggccaccgccacgcgctgcgcctgccccacggaaaggcgggcagcctggtcgccaacaggcgtatcaacgccttgtgggaggagcggtagaaactcgctgacccaggcgttatccagcgctgcttgtaattcttgttcgctggcatcaggtcgcgccagtagtacgttatcccgcaatgttgctgccggtaattgtgggttttgcccaacccaggagagatgtttacgccatgattctggtgataaatcgcgtaattctatcccgttgattcgtagcgatccctgatatgagagaaaaccagaaagcgcgttcagcagtgagcttttacctgaaccgctgcgaccaaccaacaccgcacgttggcctgctggcaaagtaaagttcagcggtccggccagcgttttaccttccggcgacgtgataaacagctcctcggcctcaatggtcaccggatcggtcgatgctaattccgcctcaccacgttgcggatgggcgagcggggtttccataaacgttttcagactgtcagctgcgccaacagcctgggctttagcatgataaaacgtaccgagatcgcgtaatggctggaaaaactctggcgcaaggatcagggccagaaaacccgcagccagcgtcacaccggtatcgtagtgaccaaaatccagctcgccgagataggaaaaaccaaagtagaccgccaccagagcaattgacagcgaggtaaaaaattcgagaatgccggaggataaaaacgccagccgtagcacttccattgtccgttggcggaaatcttccgaagcagaacgaatactttcaatttcagcttcaccacgaccaaaaatacgcaatgtttccatgccgcgcaggcgatcgaggaaatgcccacttaagcgagcaagagcgagaaagttacgtcggttagcatcggcagcccccattccaaccagcgccataaacaacggaattaacggtgcagtgcccagcagaatgagcgccgcagcccagttagaggggaagattgccaccacaatcagcaacggcaccgacactgccagcgccatttgcggcagatagcgtgcatagtaatcatgcatatcgtcaatttgctcgagtaccagcgtcgcccagctccccgcaggtttaccctgaatccacgctggccctgcttgttgcagacggtcgagaacctgacggcggatggcaaagcggatatgctgcccggcgtgataacccacccgttcgcgtaaccagaccacccatgcgcgcagtacaaaggtcagaaccagtaacgtaaagggaagcagcagggcttcacggggaatattctccataatcatatgttgcagaattcgcgccatgaaccaggcctgggcaatgatcaatatgccgctcacaaagcccagcagacgagaaatattcagccaacgttgggagatgacgctttgctgttttaaccagcgggttaactctttttgacgagatttattcattgcacgcttagcaggtgagttatcagaattatttgcagagcaatgttacaacggggaaaaaataaaggcgacccatagtcgcatggtgtcgccttctttacttttgttactgatttgtaaaattattttgcgtcagctaaaccatcgaggtagcgttccgcatcaagtgctgccatgcagcctgtaccggccgaagtaatggcctggcgataaatgtgatccatcacgtcgcctgcggcaaagacgccaggaatgctggtctgggtggcattaccatgaatacccgactgtactttgatgtagccgttttccagttccagctgcccttcgaaaatcgcagtattcgggctgtgaccgatagcaacaaacagaccggcaacgtcgagtgactcgatgttatcgctgttttgcgtatcgcgcagacgaacgccagtgacacccatttgatcgccggtcacttcttccagcgtacggttggtgtgcagaatgatgttgccgttctccactttatccatcaggcgcttaatgaggattttttccgcgcggaaaccgtcacggcggtgaatcagatgcacttccgaagcgatgttagacagatacagcgcctcttcaaccgcggtattgccgccgccgatgaccgcaactttctggttgcgatagaagaaaccgtcgcaggttgcacaagcagaaaccccacggcctttaaaggcttcttcagagggcaggccgagatagcgtgcagaagctccggtggcaataatcagcgcgtcgcaagtgtattcgccgttatcgccattcagacggaacggacggttttgcagatccaccttgttgatatgatcaaaaatgatctcagtttcaaacttggtggcatgttcgtgcatgcgctccattaataacggaccggtcagatcgtttggatcgccaggccagttttccacttccgtggtggtggtcagttggccgcctttttccatgccggtaatcagcacaggttgcaggttggcgcgcgccgcgtagacagcagcggtgtatcccgccgggcctgaacccaggataagcagtttactgtgtttggtcgtgcccatgagatccccatagttgttggcagacaatgggcaggattgtagggaatttacagacgtaaaaaaagagtatgacgattttgttaacaatttgtgcaatcggcagcatcgataagcaggtcaaattctcccgtcattatcacctctgctacttaaatttcccgctttataagccgattaaatgatgaataaacgcccctgttaatgaatatctggcatgttgtactaaaaatcgatgttttgctttgacaatcccctggtgttttgcgaaaacattcgaggaagaaaaaaaacagtattcttatatgcgcataaccatgcatgtaaataccatgtttaccgtgctagtgaaatctacgtatggcgtggacagacgccattcgtgatgtcgatagctgccacaaggcaacggtcttctcaccgtagacccaggcattgcgcgccgtgaatcttcatgatttcggtctatcgtgacgggtagcgactctgaacagtgatgtttcagggtcagacaggagtagggaaggaatacagagagacaataataatggtagatagcaagaagcgccctggcaaagatctcgaccgtatcgatcgtaacattcttaatgagttgcaaaaggatgggcgtatttctaacgtcgagctttctaaacgtgtgggactttccccaacgccgtgccttgagcgtgtgcgtcggctggaaagacaagggtttattcagggctatacggcgctgcttaacccccattatctggatgcatcacttctggtattcgttgagattactctgaatcgtggcgcaccggatgtgtttgaacaattcaataccgctgtacaaaaacttgaagaaattcaggagtgtcatttagtatccggtgatttcgactacctgttgaaaacacgcgtgccggatatgtcagcctaccgtaagttgctgggggaaaccctgctgcgtctgcctggcgtcaatgacacacggacatacgttgttatggaagaagtcaagcagagtaatcgtctggttattaagacgcgctaacacggaacaggtgcaaaatcggcgtattttgattacactcctgttaatccatacagcaacagtactggggtaacctggtactgttgtccgttttagcatcgggcaggaaaagcctgtaacctggagagcctttcttgagccaggaatacattgaagacaaagaagtcacattgacaaagttaagtagcggccgccgccttctggaggcgttgctgatccttattgtcctgtttgccgtctggttgatggctgccttactaagctttaacccttcggaccccagctggtcgcaaacggcctggcatgaacctatccataatttaggtgggatgcccggtgcgtggttggcagatacgctgttctttatttttggcgtgatggcttacaccattcccgtcattattgtcggcggttgttggtttgcctggcgtcatcagtccagcgacgaatacattgattattttgccgtttcgctacgcatcattggcgttttggcgctcatccttacctcctgtggtctggcggcaatcaacgctgacgatatctggtattttgcctccggtggcgtcattggcagcttactaagcactacgctacaaccactgctacacagtagcgggggaactattgcgctgctctgcgtttgggcagcgggcctgacgttgttcaccggttggtcatgggtgaccattgctgaaaaactcggcggctggattttaaacattctcaccttcgccagtaatcgtacccgtcgcgatgatacctgggtcgatgaagatgagtatgaagacgacgaagagtatgaagatgaaaatcacggcaaacagcatgaatcacgccgtgcccgtattcttcgcggcgcgctagcgcgtcgtaaacggttggcggaaaaattcattaatccgatggggcggcaaacagacgctgcgttgttctccggtaagcggatggatgatgacgaagagattacctacactgcacgcggtgtggctgccgacccggacgacgtcctattttcgggcaatcgtgcaacgcagccagaatatgacgaatacgatccattattaaacggtgcgccaattaccgaacctgtcgctgtagcagctgctgctaccacggcgacacaaagctgggctgcgccggttgaacctgtgactcagacgccgcctgttgcctctgttgatgttccacctgcgcaacctacagtagcctggcagcctgtaccgggtccacaaacgggagagccggttattgctcctgcaccggaaggttacccacagcagtcacaatatgcgcagcctgcagtgcaatataatgagccgctgcaacaaccagtacagccgcagcagccgtattatgcacctgcagctgaacaacctgcgcaacagccgtattatgcccctgcgccagaacaaccggtggcaggtaacgcctggcaagccgaagagcagcaatccacttttgctccacagtctacataccagactgagcaaacttatcagcagccagccgctcaggagccgttgtaccaacagccgcaacccgttgaacagcagcctgttgtggagcctgaacccgttgtagaagagacaaaacccgcgcgtccgccgctttactactttgaagaagttgaagagaagcgagcccgtgaacgtgaacaacttgcggcctggtatcaaccgattccagaaccggttaaagaaccagaaccgatcaaatcttcgctgaaagcaccttctgttgcagcagtacctccagtagaagccgctgccgctgtttccccgctggcatctggcgtgaaaaaagcgacactggcgacgggggctgccgcaaccgttgccgcgccagtcttcagtctggcaaatagcggtggaccgcgtcctcaggtcaaagaggggattggtccgcagttgccacgaccgaaacgtatccgcgtgccaactcgtcgtgaactggcgtcttacggtattaagctgccctcacagcgtgcggcggaagaaaaagcccgtgaagcccagcgcaatcagtacgattctggcgatcagtacaacgatgatgaaatcgatgcgatgcagcaggatgaactggcacgtcagttcgcccagacacagcagcaacgctatggcgaacagtatcaacatgatgtgcccgtaaacgcagaagatgcagatgctgcggcagaggctgaactggctcgtcagtttgcgcaaactcaacaacaacgttattccggcgaacaaccggctggggcgaatccgttctcgctggatgattttgaattttcgccaatgaaagcgttgctggatgatggtccacacgaaccgttgtttacgccaattgttgaacctgtacagcagccgcaacaaccggttgcaccgcagcagcaatatcagcagccgcaacaaccagttccgccgcagccgcagtatcagcagccacaacagccggttgcgccgcagccacaatatcagcagccgcaacaaccggttgcgccacagcagcaatatcagcagccgcaacaaccggttgcgccgcagcagcagtatcagcagccacaacagccagttgcgccacaaccgcaggataccctgcttcatccgctgttgatgcgtaatggcgacagccgtccgttgcataaaccgacgacgccgctgccttctctggatttgctgacaccgccgccgagcgaagtggagccggtagatacctttgcgcttgaacaaatggctcgcctggtggaagcgcgtctggctgatttccgtattaaagccgatgtcgtcaattactctccggggccggttatcactcgctttgaattgaacctggcaccgggcgtaaaagcggcgcgcatttctaacttgtcacgggaccttgcccgttcactttcgacggtggcggtgcgtgtcgttgaagttattcctggcaaaccctatgtaggtctggagttaccgaataaaaaacgacaaaccgtttatctgcgcgaagttttggataacgccaaattccgcgataatccgtcgccattaaccgtggtgctgggtaaagatatcgccggtgagccggtggttgccgatctggcgaaaatgccgcacttgttggttgcggggactaccggttccggtaaatctgtcggtgtgaacgcgatgatcctgagcatgctttataaagcacagccagaagatgtgcgtttcatcatgatcgacccgaaaatgctggagctttcggtttatgaaggcattccgcatctgttaacggaagtcgttactgatatgaaagatgccgccaacgcgctgcgctggtgtgttaacgagatggagcgtcggtataaactgatgtctgcgctgggtgtgcgtaatctggcgggttataacgaaaaaattgctgaagccgatcgcatgatgcgtccgattccagacccgtactggaagccgggtgacagtatggatgcccagcatccggtgctgaaaaaagaaccatacattgtggtgttggttgacgaatttgccgacctgatgatgacggtaggtaaaaaagtggaagagctgatagcacgtctggcgcaaaaagcccgtgccgcgggtatccacctcgtactggcaactcagcgtccatcggttgatgttattactggtctgattaaagcgaatattccgacccgtatcgcctttaccgtatccagtaagattgactcacgtaccattcttgatcaggctggcgcggaatcactgctgggtatgggggatatgctctactctgggccgaactccacgttgccggtacgtgtccatggtgcttttgttcgcgatcaggaagttcatgccgtggtgcaggactggaaagcgcgtggtcgcccacagtatgttgatggcatcacctccgacagcgaaagcgaaggtggtgcgggtggtttcgatggcgctgaagaactggatccgttgttcgatcaggcggtgcagtttgtcactgaaaaacgcaaagcgtcaatttctggcgtacagcgtcagttccgcattggttataaccgtgcagcgcgtattatcgaacagatggaagcgcaggggattgtcagcgaacaggggcacaacggtaatcgtgaagtgctggccccaccgccgtttgactaactaatgcatcgtatgccggataaggcgcggtagcgtcgcatccggcactctatcaactgaaaattcagtattttcttctttcctcaagctgattattagcctggaatagagagtagagggaactcccgatcgggagtgacgtaatttgaggaataatgatgaaaaaaattgccatcacctgtgcattactctcaagcttagtagcaagcagcgtttgggctgatgccgcaagcgatctgaaaagccgcctggataaagtcagcagcttccacgccagcttcacacaaaaagtgactgacggtagcggcgcggcggtgcaggaaggtcagggcgatctgtgggtgaaacgtccaaacttattcaactggcatatgacacaacctgatgaaagcattctggtttctgacggtaaaacactgtggttctataacccgttcgttgagcaagctacggcaacctggctgaaagatgccaccggtaatacgccgtttatgctgattgcccgcaaccagtccagcgactggcagcagtacaatatcaaacagaatggcgatgactttgtcctgacgccgaaagccagcaatggcaatctgaagcagttcaccattaacgtgggacgtgatggcacaatccatcagtttagcgcggtggagcaggacgatcagcgcagcagttatcaactgaaatcccagcaaaatggggctgtggatgcagcgaaatttaccttcaccccgccgcaaggcgtcacggtagatgatcaacgtaagtagaggcacctgagtgagcaatctgtcgctcgatttttcggataatacttttcaacctctggccgcgcgtatgcggccagaaaatttagcacagtatatcggccagcaacatttgctggctgcggggaagccgttgccgcgcgctatcgaagccgggcatttacattctatgatcctctgggggccgccgggtaccggcaaaacaactctcgctgaagtgattgcccgctatgcgaacgctgatgtggaacgtatttctgccgtcacctctggcgtgaaagagattcgcgaggcgatcgagcgcgcccggcaaaaccgcaatgcaggtcgccgcactattctttttgttgacgaagttcaccgtttcaacaaaagccagcaggatgcatttctgccacatattgaagacggcaccatcacttttattggcgcaaccactgaaaacccgtcgtttgagcttaattcggcactgctttcccgtgcccgtgtctatctgttgaaatccctgagtacagaggatattgagcaagtactaactcaggcgatggaagacaaaacccgtggctatggtggtcaggatattgttctgccagatgaaacacgacgcgccattgctgaactggtgaatggcgacgcgcgccgggcgttaaatacgctggaaatgatggcggatatggccgaagtcgatgatagcggtaagcgggtcctgaagcctgaattactgaccgaaatcgccggtgaacgtagcgcccgctttgataacaaaggcgatcgcttttacgatctgatttccgcactgcataagtcggtacgtggtagcgcacccgatgcggcgctgtactggtatgcgcgaattattaccgctggtggcgatccgttatatgtcgcgcgtcgctgtctggcgattgcgtctgaagacgtcggtaatgccgatccacgggcgatgcaggtggcaattgcggcctgggattgctttactcgcgttggcccggcggaaggtgaacgcgccattgctcaggcgattgtttacctggcctgcgcgccaaaaagcaacgctgtctacactgcgtttaaagccgcgctggccgatgctcgcgaacgcccggattatgacgtgccggttcatttgcgtaatgcgccgacgaaattaatgaaggaaatgggctacgggcaggaatatcgttacgctcatgatgaagcaaacgcttatgctgccggtgaggtttacttcccgccggaaatagcacaaacacgctattatttcccgacaaacaggggccttgaaggcaagattggcgaaaagctcgcctggctggctgaacaggatcaaaatagccccataaaacgctaccgttaatgttatcgttgcggtaatgttgttactgtatccctgtggtcgcaggctgtggccacatctcccatttaattcgataagcacaggataagcatgctcgatcccaatctgctgcgtaatgagccagacgcagtcgctgaaaaactggcacgccggggctttaagctggatgtagataagctgggcgctcttgaagagcgtcgtaaagtattgcaggtcaaaacggaaaacctgcaagcggagcgtaactcccgatcgaaatccattggccaggcgaaagcgcgcggggaagatatcgagcctttacgtctggaagtgaacaaactgggcgaagagctggatgcagcaaaagccgagctggatgctttacaggctgaaattcgcgatatcgcgctgaccatccctaacctgcctgcagatgaagtgccggtaggtaaagacgaaaatgacaacgttgaagtcagccgctggggtaccccgcgtgagtttgactttgaagttcgtgaccacgtgacgctgggtgaaatgcactctggcctcgactttgcagctgcagttaagctgactggttcccgctttgtggtaatgaaagggcagattgctcgcatgcaccgcgcactgtcgcagtttatgctggatctgcataccgaacagcatggctacagtgagaactatgttccgtacctggttaaccaggacacgctgtacggtacgggtcaactgccgaaatttgctggcgatctgttccatactcgtccgctggaagaagaagcagacaccagtaactatgcgctgatcccaacggcagaagttccgctgactaacctggtgcgcggtgaaatcatcgatgaagatgatctgccaattaagatgaccgcccacaccccatgcttccgttctgaagccggttcatatggtcgtgacacccgtggtctgatccgtatgcaccagttcgacaaagttgaaatggtgcagatcgtgcgcccagaagactcaatggcggcgctggaagagatgactggtcatgcagaaaaagtcctgcagttgctgggcctgccgtaccgtaaaatcatcctttgcactggcgacatgggctttggcgcttgcaaaacttacgacctggaagtatggatcccggcacagaacacctaccgtgagatctcttcctgctccaacgtttgggatttccaggcacgtcgtatgcaggcacgttgccgcagcaagtcggacaagaaaacccgtctggttcataccctgaacggttctggtctggctgttggtcgtacgctggttgcagtaatggaaaactatcagcaggctgatggtcgtattgaagtaccagaagttctgcgtccgtatatgaacggactggaatatattggctaatacccaatttttctgaatctaaaaagcgcctgcgggcgctttttttgtctccctttgataccgaacaataattactcctcacttacacgtaatactactttcgagtgaaaatctacctatctctttgattttcaaattattcgatgtatacaagcctatatagcgaactgctatagaaataattacacaatacggtttgttactggaatcaatcgtgagcaagcttgagtgagccattatgaaaacgaaaatccctgatgcggtattggctgctgaggtgagtcgccgtggtttggtaaaaacgacagcgatcggcggcctggcaatggccagcagcgcattaacattaccttttagtcggattgcgcacgctgtcgatagcgccattccaacaaaatcagacgaaaaggttatctggagcgcctgtacagttaactgtggtagtcgctgcccgctacgtatgcacgtcgtggacggtgaaatcaaatatgtcgaaacggacaataccggcgatgacaattacgacggcctgcaccaggttcgcgcctgcctgcgtgggcgttccatgcgtcgccgtgtctacaatccggaccgcctgaaatatccgatgaaacgagtcggggcgcgcggtgaaggcaaattcgagcgcattagctgggaagaagcctacgacatcatcgcgaccaatatgcagcgcctgatcaaagagtacggcaacgagtctatctatctgaactatggcaccggtacgctgggcggcaccatgacccgctcctggccgccgggaaataccctggtcgcgcggctgatgaactgctgcggcggctatctgaaccattacggcgactactcctccgcgcaaattgcggaaggtttgaactatacctacggcggctgggcagatggcaacagcccgtcggatatcgaaaacagtaagctggtagtgctgtttggtaataaccctggcgaaacgcgaatgagtggcggtggggtgacttactatcttgaacaggcacgccagaaatctaatgcccgcatgatcatcatcgatccgcgctataccgacaccggtgccgggcgcgaagatgagtggatccctattcgtccgggaacagatgccgcactggttaacggtctggcgtacgtcatgatcactgaaaacctggtggatcaggcattcctcgataaatattgcgttggctacgatgagaaaaccctgccagccagtgcgccgaaaaatggccactataaagcttatattctgggtgaagggccagatggcgtggctaaaacgccggaatgggcctcgcaaatcactggtgttccggcagacaaaatcatcaaattggctcgtgaaatcggtagtaccaaaccggcgtttatcagccagggatggggcccgcagcgtcacgctaacggtgaaatcgcaacccgtgctatctcgatgctggcgattctgaccggtaacgttggtattaacggaggcaacagcggcgcgcgtgaaggttcatacagcttaccgtttgtccgtatgccgaccttggaaaacccgatccagaccagcatttcgatgtttatgtggaccgatgccattgaacgtggcccggaaatgacggcgctgcgtgatggtgtacgcgggaaagataagctggatgtgccgatcaaaatgatctggaactatgccggtaactgcctgattaaccagcattctgaaatcaaccgtacccatgaaatccttcaggatgataagaagtgcgagctgattgtggttatcgactgccacatgacctcatcggcgaaatatgctgacatcctgctgcctgactgcaccgcttccgaacagatggactttgcgctggatgcatcctgcgggaatatgtcttacgtgattttcaacgatcaggtgattaaaccgcgctttgaatgtaagaccatctatgaaatgaccagcgaactggcaaaacgtcttggcgttgagcaacagtttactgaaggccgtacccaggaagagtggatgcggcatctgtatgcccagtcgcgggaagcgattcctgaactgccaacgtttgaagagttccgcaagcaggggatctttaaaaagcgcgacccacaagggcatcacgttgcttataaagccttccgtgaagatccgcaggcaaacccactgactacgccatcgggcaaaattgagatttattcgcaggcgctggctgacattgccgctacctgggaattgcctgaaggcgatgtgatcgatccactgccgatctacacgccgggctttgaaagttatcaggatccgctgaacaaacagtatccgctgcagcttacaggtttccactataaatctcgcgttcactcaacttacggcaacgttgatgtgctgaaagcggcttgccgtcaggaaatgtggatcaacccgcttgatgcccaaaaacgcggtatccacaacggcgataaagtcaggatctttaacgatcgtggtgaggttcatattgaggcgaaagtgacgccacgaatgatgccgggtgtggtcgcactgggtgaaggtgcctggtatgacccggatgcaaaacgtgtcgataagggtggttgtattaacgtactgaccactcaacgtccgtctcctctcgctaaggggaatccgtcacatacaaaccttgttcaggttgaaaaggtgtaaggagtaaccgatgacaacccagtatggattttttattgattccagccgttgcaccggttgcaaaacctgcgagctggcctgtaaagactacaaagatttgacgccagaagtcagcttccgccgcatttatgaatatgctggcggcgactggcaggaagataacggtgtctggcaccagaacgtgtttgcctactatctgtcgatttcatgtaaccactgcgaagatccggcttgtactaaagtctgcccgagcggtgcgatgcataaacgtgaagatggttttgttgtggtcgatgaagatgtgtgcattggctgccgctactgccatatggcttgcccgtatggcgcaccgcaatataacgaaacgaaaggccatatgaccaaatgcgatggttgttatgaccgtgttgcggagggtaaaaagccgatctgtgttgaatcttgtccgctgcgggcgctggatttcggccctatcgacgagctgcgtaaaaaacatggcgatctggcggccgttgcgccgttgccgcgagctcactttaccaaaccgaatattgtgatcaaacccaatgccaatagccgcccgaccggggataccactggctatctggcaaacccgaaggaggtgtgagatgggaagtggatggcatgaatggccgctgatgatcttcacggtcttcgggcaatgtgtagcaggtggttttatcgttctggctttggcgctgctcaaaggcgacctgcgagcagaagcccagcagcgtgttatcgcctgcatgtttggtttatgggtgctgatgggcattggctttatcgcctctatgctccatcttggttcaccaatgcgcgcttttaactcgctcaaccgggtaggggcttcagcactcagtaacgaaatcgccagcggttcgatcttttttgccgtaggcggcatcggctggttgctggcaatgctgaaaaagctgtcaccggcattgcgtacgctgtggctgatagtgacgatggttcttggcgtcatctttgtctggatgatggtgcgtgtgtataacagcattgataccgttccgacctggtacagcatctggacgccgatgggcttcttcctgacgatgtttatgggcggcccgttactgggttacctgttgttgagtctggctggcgtcgatggctgggcgatgcgtctgctgccagcaatttctgtactggcactggtagtgagtggcgtggtgtcagtgatgcagggcgcagagctggcgactattcatagttctgtgcagcaggccgcagcgctggtgccggactatggtgcgctgatgtcctggcggatcgtgcttttggccgttgccctgtgcttgtggattgcaccacagctaaaaggttatcagcctgcggttccgctactttctgtatcattcattctgcttctggcaggggaattaatcggtcgcggcgtattctatggtttgcatatgaccgtggggatggccgtcgcaagctaatcataacaaccggggtttcggccccggttctcttttatttctgcttcgttaacgtgtcataactggtcatcaaattacgataatcaggaatgtggttagagaacaacgtcgccagtccttcaatatcattacgccagtcgcgatgcagctcgcacgccacgccgaaccatgtcatcaattgcgcaccagcttgcgacaagcgatcccatgccgaatgccgggtaatttcattaaaggtccctgacgcgtcagtcacgacaaagacgtcaaacccttcttcaatggctgaaagcgccgggaatgccacgcaaacttcggttaccacaccggcaataattaactgttttttacctgtcgctttgacagcttttacaaaatcttcgttatcccaggcgttaatatttcccgggcgagcaatgtaaggtgtatcggggaattgtgctttcagttctggaactaatgggccgttaggaccggtttcaaaactggtggtaagaatagttggtaagttgaaatacttagccaggtcacccagcgccagcacgttatttttaaacttatcgggttcgatatcccgtacaagggaaagtaaaccagcctggtgatcaacaagcaaaacggcagcatcatttttatcaagacgaacatacggtttggtcatcctcttctcctttcgagagtcagtggtacgtctgaaatcgatcagacgcgatgcattgctctgaaagcatagacgggaaatatgagtttgctgtgaccatgaaatttttcgactgaacgaagcgtatgaaatttgtgttagttcaataaaaacaatcagatgagactaatcatctcttcagcattagcgttatgaatgagtaatataaatcgataataccgccgctgggatatcgcgtattttcacccattgacaatgtttttggcggtggcatgatgcgcatgaaatttgaacttcctcacggttttaattcatgtccacgtatacccagcctgtcatgcttttgctgtctggcctgcttttgttgactctggcgattgcggtgttaaatacactcgtgccgctttggctcgcccaggaacacatgtccacatggcaggtaggcgttgtcagctcatcctattttaccggcaaccttgtcggtacattgctgacagggtatgtcattaagcgcattggctttaaccgcagctattatctggcctccttcatttttgccgctggctgtgccggccttggcctgatgattggattctggagctggttggcttggcgttttgtcgcgggcgtcggctgtgccatgatttgggtggttgttgagagcgcgctgatgtgcagtgggacgtcacgtaaccgtgggcgtttgcttgctgcgtatatgatggtttattacgtgggaacgtttttaggccagttactggtcagcaaagtttcaaccgagctgatgtccgtattgccgtgggttacaggtttgacgttggcagggatcttaccgctgttgtttacgcgtgtgctgaatcagcaggctgaaaaccatgattcgacgtcaattacgtcaatgctaaaactccgtcaggcgcggcttggcgtgaatggctgcattatctcaggaatcgttctgggatctctatatggcctgatgccgctgtacctcaatcacaaaggggtgagcaatgccagcattggtttctggatggcggtactggtcagtgcgggtatccttggacaatggccgattggacgtctggcggataagtttggtcgactgctggtgttgcgtgttcaggtctttgtcgtcattctcggcagtatcgcgatgcttagccaggcggcgatggccccagcgttattcatcctcggtgccgctggctttacgctatatccggtggcgatggcatgggcttgcgagaaagttgaacatcatcaactggtggcgatgaaccaggccttactgttgagctatactgtgggaagtctgcttggcccgtcatttaccgctatgctaatgcagaatttctccgataatttattgtttatcatgatcgccagcgtatcgtttatctatttgctgatgctgctgcgcaacgccggtcatacgccgaaacccgttgctcacgtgtaaatgaattcaagcagagtgtgaacttactgtttcacactctgcttttttgtttcttctatctgacttgctttattccaaattttattcgtttaaaaataaaatgtgcagcaggttataattttgcatttcgctatttccgcacttcttatttgccgcgcataatccctcgttttaccgatgcccctttaattttggcgaaggatttgtctatggctgggaatgttcaggaaaaacagttgcgatggtacaacattgcgctgatgtcttttatcactgtctggggttttggcaacgttgttaataactatgccaaccaggggctggtggttgttttttcatgggtgtttatctttgcactctatttcacaccttatgcgctaattgttggtcagttaggctcgaccttcaaagatgggaagggcggggtcagtacctggattaaacacacgatgggacccggactggcttatctcgccgcgtggacctactgggtggtgcatattccctatctggcacaaaaaccccaggcaattctgattgcgctcggttgggcgatgaaaggcgacggttcgctaatcaaagaatattcagtcgtagcgttacaggggttaacgctggtgctgtttatcttctttatgtgggttgcttcacgcggtatgaaatcgctgaaaatcgtcggttctgtggcagggattgctatgtttgttatgtcactcctgtatgtggcgatggcggtaaccgcgcctgcaattactgaagtgcatattgcgaccacaaacattacctgggaaacgttcattcctcatatcgactttacctacattaccactatttcaatgctggttttcgcggttggcggagcagagaagatttctccttacgttaatcaaacgcgcaacccaggaaaagaatttccaaaagggatgttatgcctggcggtgatggttgcggtttgtgccattctgggctcgctggcgatggggatgatgtttgattcgcgtaatatcccggatgacttaatgaccaacggtcagtattacgcctttcagaagctgggcgagtattacaacatgggtaatactttaatggtgatttacgccattgcgaataccctgggacaagtagcggcgctggtattctcgattgatgccccgcttaaagtgctattaggtgatgctgacagcaaatatattccagccagtttatgtcgtaccaacgcttctggtacgcccgttaatggctattttctgaccctggtactggtggcgattctgattatgctgccgactctcggcattggtgatatgaacaatctctataaatggctgttgaaccttaattcggtagtgatgccgctgcgttatttatgggtatttgttgcatttattgcagtcgttcgcttggcgcagaaatataaaccagaatatgtctttattcgtaataagcctctggcaatgaccgtcgggatttggtgttttgcctttaccgcctttgcctgtttgacggggatcttcccgaaaatggaagccttcactgcagagtggaccttccagttggcgctgaatgttgcaacgccgtttgtgctggtaggattaggactgatattcccgctgctggcgcgtaaagcgaatagtaaataattattgtggtcggtgacgctgactctggcagatctgacccgtttttacataatcgagaaatgcgcgcaagccgcaggacatatactggcggtttggataatagatctggaagcctggacgctctgtgctccagtcttccagtacacattctaaacgaccagtatcaaggtactccttgatctgttcatagagcagatacccgataccagcacccatcaaaacggcctccagttcagcatcaacatcatccagaatgatatttcctgcgacagcaatttccagctcctttgcaaattgccagtggaaaggtttgccgctgggataacgaaaaacaacacattgatgattaagcagatcatgaggatggcggggtttgccatatcttgcaaagtactctggcgttgctgctacacataatttcactggcgggccgatcgccacgctgatcatatctttttcgacgatgcaactaagtcgaacgccagcgtcaaagccctgttggacgatatcgacaagagagtcgtcagttgtgagctcgactttaatatcaggatattcacgtgtgaaaccaaccagtaaagacattaaaaatatacgtgcagctacccgggcggcattgattttgagcgttcctgtcggtgtcagacgaaaatcattcatctcatctaacatgatctgaatttcgtcgaaagctgggcgcaatcgttcatagagattagaacccgcttccgttaacgatacgcttcgggttgtccgattgaataagcgaattttaagacgttgttccagtgttttaatactatggctaatggcggacgaggataagcctaactcatcgcccgctgcacgaaagctttgattacgggccacggcaaagaaagtggcaaagtcagacatattcatccgcattagtgaaaatccttcattaactcatcctgaatcatcacgtttacaggattatgccgcctgcgtaaagtgcgctccagaacttaacgtggaggtaaaattatgcagtctgaacgtatttatttggtatgggcccatcctcgtcatgattcattgaccgcacatattgctgatgcgatccatcagcgggcaatggagcggaaaatacaggtgacggaactcgatttatatcggcgtaatttcaacccagtgatgacgccggaagatgaaccagactggaagaatatggataaacgttattctccagaggttcatcagctttattcagagctgcttgaacatgacacgttagtggtggtttttcctctctggtggtacagcttcccggcaatgctaaaaggatatattgacagagtatggaataatgggctggcttatggagatgggcacaaattaccattcaataaagttcgttgggtggcgctggttggaggagacaaagaatcatttgtccagatgggctgggaaaaaaatataagcgattatttaaaaaatatgtgcagttatcttggtattgaagatgccgatgtcactttcttgtgtaatacagtggtattcgatggggaagaacttcacgcgagctattatcagtcgttattatctcaggtacgggatatggtagatgcactataagatgtgttaaaaacgctgtagcagaatgaagcgcggaataaaaaagcggcaactcaataaagttgccgctttacggggaaattagaacattaccttatgaccgtactgctcaagaatgcctttcacgcgttccatggtctctttcttcggtggtttaacaccgtcgagtttgtactcttcacccattgccacccatttgtgtttgcccagctcgtggtaggggagaagctcgattttctcaacgttgcccatatcacgggtaaattcaccgaggcgatgcgctgaatcgtcatcgtcagaccagcctgggacaacaacgtagcggatccacaccttcacatttttgttcgccagatatttagcgaactccagcgtgcggtggttggaaactccaaccagattttggtggatctcgtcgttcatctgtttgagatcgagcattaccaggtcggttacttccagcagttcatcaatcaccggatcgtaacgacgaacaaaaccgttggtgtccagacaggtatgaatgccttcttttttgcaggcgcggaaccagtcacgaacaaactcagcttgcaggattgcttcaccgccggatgcggtaacgccgccgccggaagcgttcataaagtggcgataggtcaccacttccttcatcaaatcttcaacggtaacttctttaccgccatgcgtgtcccaggtgtcgcggttatgacaatacaggcagcgcatcaggcagccctggaaaaaggtgataaagcgaatacctgggccgtctacggttccacaggattcaaaggagtgaatgcgaccaataactgacattgcggtgtttctccagatgtggcccatctgaggccgtgttggtgcgcagctcgaaggctacgtcgagtctgttttggcagtcaccttaaagtatagatagctgacaaaaaaggctctcgcgctaaaaaaggccccactttcgtggagcctttattgtacgctttttactgtacgatttcagtcaaatctaattacatagattgagtgaaggtacgagtaataacgtcctgctgctgttctttagtcagcgagttgaaacgtactgcgtagccagatacacggatggtcagctgcggatatttttccgggttttccatcgcgtcgagcagcatttcacggttcatcacgttaacgttcaggtgctgaccaccttcgatggatgcttcgtggtggaagtaaccatccatcagaccagccaggttggtcttacgaacttcgtcgtctttacccagtgcgttcggaacgatagagaaggtgtaggagataccatctttagcgtaagcaaacggcagtttagcaacggaagtcagagaggctactgcacctttctggtcacgaccgtgcatcgggttagcacccggtccgaacggcgcgccagcacgacgaccgtctggggtgttacccgttttcttaccatacacaacgttagaagtgatggtcagaacagactgagtcgggatagcgtcacggtaggtgtgcagtttctgaattttcttcatgaaacgttctaccaggtcaacagccaggtcatctacacgcggatcattgttaccaaactgcgggtattcgccttcgatttcgaagtcgatagccagaccgtcttcgtcacgaatcggtttaactttcgcatatttgattgcagacagggagtcagcagcaacggacagaccagcgataccacacgccatggtgcggataacgtcacggtcgtgcagcgccatcagagaggcttcgtagctgtacttgtcgtgcatgtagtggatgatgttcagtgcagtgatgtactgtttagccagccagtccatgaagtgatccatgcgctccatcacttcatcatagttcaggacatcgcctttgatcggttcagacttcggaccaacctgcattttcagtttttcgtcaacgccgccgttgattgcgtacagcatggttttcgccaggtttgcacgcgcaccgaagaactgcatttgtttaccaacgatcatcgggcttacgcagcaagcaatagcgtagtcatcgttgttgaagtccggacgcatcaggtcatcgttctcatactgcagagaagaggtgtcgatggacactttagcggcgaatttcttgaagttcagcggcagtttttcagaccacagaatggtcatgttcggttccggagacggacccatggtgtacagggtgttcaggaaacggaagctgtttttggtaaccagggtacgaccgtcgaggcccataccaccgatagattcggttgcccagatcgggtcgccagagaacagttcatcgtattccggagtacgcaggaagcgaaccatacgcagtttcatgaccaggtggtcaaccatttcctgcgcttcttgttcggtgatcttgccagctttcaggtcacgttcgatgtacacatccaggaaggtggaggtacgaccgaaggacattgcagcaccgttctgagacttaacagcagccaggtagccgaagtaagtccactggatagcttcctgagcgttggtagccggaccagagatgtcgtagccgtatttcgcagccatttctttcatctgacccagagcgcggtgctgttcagcgatttcttcgcgcagacggatagtctgttccaggtttacgccgttttccagatcagcctgcagagaagtgaactgtgccagtttgtctttcatcaggtagtcgataccgtacagcgcaacgcgacggtagtcaccgatgatacggccacggccatatgcatctggcagaccggtcagaacaccagatttacggcaacgcaggatgtccggagtgtaaacgtcgaacacgccctggttgtgagttttacggtattcagtgaagatttttttgatcatcggatccagttcgcggttgtacgctttgcaggaaccttcgatcattttgataccaccgaacgggataagagcacgtttcagcggagcttcagtctgcagaccaacgattttctcaagctgcttgttgatgtagccagcgtcgtgagaggtgatggtggaagcaacagcggtgtcaaagtcaactggcgcgtgagtgcggttttccagtttaacgccttccattactttgtcccacagggtggtggtcgcttcagtagcgccagccaggaaggactcgtcaccctcgtacggagtgtagtttttctgaatgaagtcacggacgtttacttcattctgccagtcacctttggtaaaaccttcccaggctgtggctaacttttcattaagctcggacatgtaacacctaccttcttaagtggattttttatttactgcgtacttcgacaaccattaatggtggtcgttttcacgcaggtaaatgacccagtatgtcaacccaaccaacaaaccaccaccgataatgttgccgatcgtaaccggaatcaggttatcagtgatgaaattcatcacggtcaggtgagaaaaattttccggtgcagaaccgactgcggtccaaaattccggggatgcgaagtcgcggattacaatacccatcgggatcataaacatgtttgcgatactgtgctcaaaaccgctggcaacaaacatcgcgaccggcagcaccataatgaacgctttgtccatcaggctgcggccagaataactcatccatactgccagacataccatcaggtttgccaggataccaagacagacggcctcaataaaagtatggtgcactttgtggtcggcggtttgtaggacgtttagtccccattgaccatttgcggtcatatactcgccggaaagccacattaaaagtacaaacagcagtgcgccgaccaggttgccaaaatagacatttagccagtttttcgccaactgaccccaggtgatgcgcccactcgccttagcaacaacaatcaacacggtggaagtaaagagatcggctccgcagacaacacaaagaatcagccccagagagaagcaaatgccgccaaccagttttgccatgccgaagggcattgtgcctgtgccagtggttgctgtgatatagaagacgaatgcgattgagatgaaaacaccggcggtaatcgccagatagaaagtcttaagcggatgtttcgttgctttatagacacccgcctcttcggccactttggccattgcagcaggaagtaaaagatcaaaagggttgtcagctttcacactaactctctctttattaagtcggcgacgagatactaacaaagcattatagatgagaaattgatatagatcatatctcgcctggcttataggcccgtaactcgcatggtttttatgcaaatacggagtaaatatttgattatccaaataaaaataaattttaaaaattaacaaatgagttgaattttttccgcatcctccgctaaaacagttaattaaaagggagcatcaggcgaataaagtaacaatatcgatcgtatttattaaatacaaattaccgatatttaaccttataattacaattattttattaatgcaaatatatgtaaagcggggcattaaaaaaacgccccgtaatataactcagactaatcattaagcctacattgcgtaggctatttgattttattttgcccagaatgctgctttggcgcgctgcagcttttcgtaggccttcaacaacgactgatgtgcagcaaacgcgtgcagatcgctatctaccggttgcaggccgtaaaacgccgcttcgccgctcattgccgcactggcggcttctacggcatctgcgccgtacatgcgaacaaacgcattcagatattgcagcggctggcgatcttcttcctgtgccagtaataacaacgtttgcaggcagcgataatagttggcgcgttccggactaaatactgatgagttaaactccatcgtccattcggtccagaccagagcctgttccagatcgccaccagccagcgccagcatggcttttaattcaccgatacgcagggtgtaccaaccgttatccgacccggtcgccagacccaacagctcacgcacgcgggtaaagtcatcaaaaccttcttcatccagttgctcgatgaggttcaggtaatcttctttttcccactcgctgcctggtagcgaaagaatcgtttcacgtaaatggctgcccatactgttattcgcgagccacagatcttcagccggataaatatcggacatgccaggcacgataatacggcaagcataaacgcccagatgctcgtaatcggcaatataaacttctttatcttctttgttgaagatagccatcagtgtggcgaactcttcttccgtggtgccggagaaattccagtccacaaacggataatcggcatcctgcttgaacaggtcccaggagattaaaccgctggaatcgataaagtgcgtttcgaggttggtatgttcagcgacttcttcatcatcgaaggttggcggagtaaacacatccaaatctttcaggccacgaccttgcagcagctcggtcacggtacgttccagtgctacgccaaaatcaggatgcgcaccgaaagaggcaaagcaggtaccgttagcaggattgaacagtaccacgcaaatcaccggatactggccgccaagcgaaccgtcataagcgaagattgggaaaccctccgcttccagcgtttcgatggcttcaactactgctgggtaacgcgccagcacgtctgccgggatctctggcaggctgatgctttcagcaataatgcggtttttcacgtagcgttcgaaaacttcagacaatccctgaacgcgtgcttcgttgcgggtattacctgcggacataccgttggagacgtacaggttaccaatgatattcatcggaatataaacggtctgattgtcggactgacgcgtaaacggcaggccgcaaataccacgatcttcgttaccggattgtaggtcaatcagcatgctgccggtcagttcattctccggatcataaaacgcgcgcagacggtcatcgagcagcccttctggcacatcgtcattttcggtcagtgggaaccatttttcgttgggataatgcacgaacggaccgttggcgatggtttcgcccagccagaagtccgcaaaaaagtagttggttgagagacgctcgaaatattcaccgagtgcagaagccagcgccgctttcttggttgcgcctttaccgttggtaaaacacagtgcgcactctttgtcgcgaatatgtacagaccagacgttaggcacgggattcagccaggaggcctcttcaatctgaaagccgaggtctgaaagtttttgctggaagcgagcgatggaatcttccagagcggcatctttgccggggataaatgtttgcgtcatgaaaatcactttagtcgtacggaaagcgcgcaataatacgggttttatctcaaaggcgctatcaccgccgccatgccgatgaactgttgactatgcttttagcggataaaccacgttaagagcataaaaatgaaggcgttcgatctccaccgtatggcatttgataaagtgccttttgatttccttggcgaagttgcactacgtagtctttatacctttgtactggtctttttgttcctcaaaatgaccggaagacgcggtgtgcggcagatgtcgctgtttgaagttttaatcattctgacgctgggatcagcggcgggagatgtggcgttttatgatgatgtgccgatggtcccggtacttatcgtctttattactctggcgttgttataccgcctggtaatgtggttgatggcgcacagtgaaaaactggaagatcttctggaaggcaagccagttgtcattattgaagatggcgagctggcctggtcgaaactcaataactccaacatgacggaatttgagttctttatggagctacgattgcgtggcgtggagcagctggggcaggtacgtctggcgattctcgaaaccaacgggcaaatcagtgtctatttctttgaagatgacaaggtgaaaccgggtttacttattttacccagtgattgtacgcagcgttacaaagtggtgccggagtcggcggactatgcctgtattcgttgtagtgaaatcattcatatgaaagcgggggaaaaacaattatgtccgcgctgtgcaaatccagaatggacgaaggcaagtcgggcaaaacgggtgacctgacagtaaaaacatcggctttttgctaataatccgagagattcttttgtgtgatgcaagccacatttttgccctcaacggttttactcattgcgatgtgtgtcactgaatgataaaaccgatagccacaggaataatgtattacctgtggtcgcaatcgattgaccgcgggttaatagcaacgcaacgtggtgaggggaaatggctcaaatcttcaattttagttctggtccggcaatgctaccggcagaggtgcttaaacaggctcaacaggaactgcgcgactggaacggtcttggtacgtcggtgatggaagtgagtcaccgtggcaaagagttcattcaggttgcagaggaagccgagaaggattttcgcgatcttcttaatgtcccctccaactacaaggtattattctgccatggcggtggtcgcggtcagtttgctgcggtaccgctgaatattctcggtgataaaaccaccgcagattatgttgatgccggttactgggcggcaagtgccattaaagaagcgaaaaaatactgcacgcctaatgtctttgacgccaaagtgactgttgatggtctgcgcgcggttaagccaatgcgtgaatggcaactctctgataatgctgcttatatgcattattgcccgaatgaaaccatcgatggtatcgccatcgacgaaacgccagacttcggcgcagatgtggtggtcgccgctgacttctcttcaaccattctttcccgtccgattgacgtcagccgttatggtgtaatttacgctggcgcgcagaaaaatatcggcccggctggcctgacaatcgtcatcgttcgtgaagatttgctgggcaaagcgaatatcgcgtgtccgtcgattctggattattccatcctcaacgataacggctccatgtttaacacgccgccgacatttgcctggtatctatctggtctggtctttaaatggctgaaagcgaacggcggtgtagctgaaatggataaaatcaatcagcaaaaagcagaactgctatatggggtgattgataacagcgatttctaccgcaatgacgtggcgaaagctaaccgttcgcggatgaacgtgccgttccagttggcggacagtgcgcttgacaaattgttccttgaagagtcttttgctgctggccttcatgcactgaaaggtcaccgtgtggtcggcggaatgcgcgcttctatttataacgccatgccgctggaaggcgttaaagcgctgacagacttcatggttgagttcgaacgccgtcacggttaatgccgaaattttgcttaatccccacagccagcctgtggggtttttatttctgttgtagagagttgagttcatggaatccctgacgttacaacccatcgctcgtgtcgatggcactattaatctgcccggttccaagagcgtttctaaccgcgctttattgctggcggcattagcacacggcaaaacagtattaaccaatctgctggatagcgatgacgtgcgccatatgctgaatgcattaacagcgttaggggtaagctatacgctttcagccgatcgtacgcgttgcgaaattatcggtaacggcggtccattacacgcagaaggtgccctggagttgttcctcggtaacgccggaacggcaatgcgtccgctggcggcagctctttgtctgggtagcaatgatattgtgctgaccggtgagccgcgtatgaaagaacgcccgattggtcatctggtggatgcgctgcgcctgggcggggcgaagatcacttacctggaacaagaaaattatccgccgttgcgtttacagggcggctttactggcggcaacgttgacgttgatggctccgtttccagccaattcctcaccgcactgttaatgactgcgcctcttgcgccggaagatacggtgattcgtattaaaggcgatctggtttctaaaccttatatcgacatcacactcaatctgatgaagacgtttggtgttgaaattgaaaatcagcactatcaacaatttgtcgtaaaaggcgggcagtcttatcagtctccgggtacttatttggtcgaaggcgatgcatcttcggcttcttactttctggcagcagcagcaatcaaaggcggcactgtaaaagtgaccggtattggacgtaacagtatgcagggtgatattcgctttgctgatgtgctggaaaaaatgggcgcgaccatttgctggggcgatgattatatttcctgcacgcgtggtgaactgaacgctattgatatggatatgaaccatattcctgatgcggcgatgaccattgccacggcggcgttatttgcaaaaggcaccaccacgctgcgcaatatctataactggcgtgttaaagagaccgatcgcctgtttgcgatggcaacagaactgcgtaaagtcggcgcggaagtggaagaggggcacgattacattcgtatcactcctccggaaaaactgaactttgccgagatcgcgacatacaatgatcaccggatggcgatgtgtttctcgctggtggcgttgtcagatacaccagtgacgattcttgatcccaaatgcacggccaaaacatttccggattatttcgagcagctggcgcggattagccaggcagcctgaatgaacaacgggcaataaatagccaaatctttctttatcaaaacgtcggcacattgtcggcgttttttttcggaccttgtgagtcattttgattaatggtagcgtcgcttgtcaatgtaagttgttgatacataatatttatatatgattaatcaacggatgattcacatgaagaatactaaattactgctggcgattgcgacctctgcagcattactgacagggtgtcaaaatacccacggtattgataccaatatggctatcagctccggtttaaatgcctataaagcagcaacattaagcgatgccgatgcaaaagcgattgccaatcagggctgtgccgaaatggacagcggcaatcaagtcgcaagtaaatccagcaagtacggtaaacgtctggcaaaaatcgccaaagcattgggtaacaatattaatggcacgccggtcaactataaggtttatatgaccagcgacgtcaacgcatgggcgatggcgaacggctgtgttcgtgtctacagtggcctgatggacatgatgaatgacaacgaaattgaaggcgttctgggccatgaactgggccacgtcgcgttgggtcactcgctggctgaaatgaaagcttcttatgcgatcgttgccgcacgcgatgccatttcagctaccagcggtgtggcttcccagctttcccgctcacaattaggtgatatcgcagaaggcgctatcaatgctaaatactcccgtgataaagagtccgaagcagatgatttctcctttgatctgttgaagaaacgtggcatcagcacccaggggctggttggcagctttgaaacactggctagcctggatggcggtcgcacccagtccatgtttgactctcacccaccatcaacagagcgtgcgcaacacatccgtgatcgtatcgcctctggtaagtaaatcattgtcatctttcgggctggtcttctgccagcccgctataattgcgcaataaatccccatctgaatacagacaaaactggtttttgcacacaacgttaacgatttgtggcgtcggcgcgtataatgcgcgcggttatgttaacggtacgcctgttttaaggagataaagatgacggcaattgccccggttattaccattgatggcccaagcggtgcagggaaaggcaccttgtgtaaggctatggcggaagcgttgcaatggcatctgctggactcgggtgcaatttatcgcgtactggcattggcggcattacatcaccatgttgatgttgcgtcggaagatgcgctggtaccgctggcatcccatctggatgtacgttttgtgtcgaccaatggcaatctggaagtgatcctcgaaggggaagatgtcagcggcgaaattcgtactcaggaagtggcgaatgcagcttcacaagtcgcggcattcccacgcgttcgtgaagcattattgcgtcgccaacgcgcgtttcgcgaattaccaggtctgattgccgatggccgcgacatgggaacggtggtattccctgatgcaccagtgaaaattttccttgacgcctcctcggaagaacgtgcgcatcgccgcatgctacagttgcaggagaagggctttagtgttaactttgagcgccttttggccgagatcaaagaacgcgacgaccgcgatcgtaaccgagcggtagcgccactggttccggcagccgatgctttagtgttggattccaccaccttaagcattgagcaagtgattgaaaaagcgctacaatacgcgcgccagaaattggctctcgcataagcgaccgaatttgcagtacccccgttgcaatggaatgacagcgggtatgttaaacaaccccatccggcatggagccaggtggacgttaaatataaacctgaagattaaacatgactgaatcttttgctcaactctttgaagagtccttaaaagaaatcgaaacccgcccgggttctatcgttcgtggcgttgttgttgctatcgacaaagacgtagtactggttgacgctggtctgaaatctgagtccgccatcccggctgagcagttcaaaaacgcccagggcgagctggaaatccaggtaggtgacgaagttgacgttgctctggacgcagtagaagacggcttcggtgaaactctgctgtcccgtgagaaagctaaacgtcacgaagcctggatcacgctggaaaaagcttacgaagatgctgaaactgttaccggtgttatcaacggcaaagttaagggcggcttcactgttgagctgaacggtattcgtgcgttcctgccaggttctctggtagacgttcgtccggtgcgtgacactctgcacctggaaggcaaagagcttgaatttaaagtaatcaagctggatcagaagcgcaacaacgttgttgtttctcgtcgtgccgttatcgaatccgaaaacagcgcagagcgcgatcagctgctggaaaacctgcaggaaggcatggaagttaaaggtatcgttaagaacctcactgactacggtgcattcgttgatctgggcggcgttgacggcctgctgcacatcactgacatggcctggaaacgcgttaagcatccgagcgaaatcgtcaacgtgggcgacgaaatcactgttaaagtgctgaagttcgaccgcgaacgtacccgtgtatccctgggcctgaaacagctgggcgaagatccgtgggtagctatcgctaaacgttatccggaaggtaccaaactgactggtcgcgtgaccaacctgaccgactacggctgcttcgttgaaatcgaagaaggcgttgaaggcctggtacacgtttccgaaatggactggaccaacaaaaacatccacccgtccaaagttgttaacgttggcgatgtagtggaagttatggttctggatatcgacgaagaacgtcgtcgtatctccctgggtctgaaacagtgcaaagctaacccgtggcagcagttcgcggaaacccacaacaagggcgaccgtgttgaaggtaaaatcaagtctatcactgacttcggtatcttcatcggcttggacggcggcatcgacggcctggttcacctgtctgacatctcctggaacgttgcaggcgaagaagcagttcgtgaatacaaaaaaggcgacgaaatcgctgcagttgttctgcaggttgacgcagaacgtgaacgtatctccctgggcgttaaacagctcgcagaagatccgttcaacaactgggttgctctgaacaagaaaggcgctatcgtaaccggtaaagtaactgcagttgacgctaaaggcgcaaccgtagaactggctgacggcgttgaaggttacctgcgtgcttctgaagcatcccgtgaccgcgttgaagacgctaccctggttctgagcgttggcgacgaagttgaagctaaattcaccggcgttgatcgtaaaaaccgcgcaatcagcctgtctgttcgtgcgaaagacgaagctgacgagaaagatgcaatcgcaactgttaacaaacaggaagatgcaaacttctccaacaacgcaatggctgaagctttcaaagcagctaaaggcgagtaattctctgactcttcgggatttttattccgaagtttgttgagtttacttgacagattgcaggtttcgtcctgtaatcaagcactaagggcggctacggccgcccttaatcaatgcagcaacagcagccgcttaatttgcctttaaggaaccggaggaatcatgaccaagtcagaattgatagaaagacttgccacccagcaatcgcacattcccgccaagacggttgaagatgcagtaaaagagatgctggagcatatggcctcgactcttgcgcagggcgagcgtattgaaatccgcggtttcggcagtttctctttgcactaccgcgcaccacgtaccggacgtaatccgaagactggcgataaagtagaactggaaggaaaatacgttcctcactttaaacctggtaaagaactgcgcgatcgcgccaatatttacggttaagttttttactcaaacttgaacgagagaaaagcacctgtcgggtgcttttttcatttctctaatctggaactggaagctgcctcgcagagttttgaacagttttcaccctttcgttaaattcttctgaatatgcctcggggaacgcaaaattcccaccagacaaccgctcaacaaagttgcacactttccataaacagggaggggtgcatgaaaataacgacagtcggtgtatgcataattagcggaatttttccgttgctgattttgccccaattgcctgggacattaacccttgcgtttctgactctcttcgcctgcgtactggcatttatccctgttaaaaccgtccgttatatcgcgctgacgttgctgtttttcgtttggggcatattatcagcaaagcaaattttgtgggcaggagaaaccttaactggcgcgacgcaggatgcaattgttgagatcactgcaactgacggcatgaccactcattacggtcaaattactcatctacaaggtcgacgtatattccctgcgtcaggtctcgtgatgtatggcgaatatcttccgcaagcggtttgtgctggacaacaatggtcaatgaaactcaaagttcgtgcagttcatggccaacttaatgatggcggctttgatagccagcgttatgccattgcccagcatcagccgctcaccggccgttttctgcaggcaagtgtcattgaaccgaattgtagcctgcgtgcacagtatctggcgtcactacaaacaacgctgcaaccctatccgtggaatgcggttattcttggtttaggtatgggggaacggttatccgtccccaaagaaatcaaaaatatcatgcgcgatactggaacggcgcatttaatggcgatatcgggattgcacatcgcttttgcggcgttgctggctgccggactcattcgcagtggacaaatttttctgcctgggcgctggatccactggcaaataccattaattggcggaatctgctgtgctgctttttatgcctggttgacgggaatgcaacctcctgcattgcgtaccatggtggcgcttgctacgtggggaatgcttaagttaagtgggcgacagtggagtggctgggatgtatggatatgttgtctggcggcaattttgctgatggatcctgttgccattctctcgcaaagtttatggctctctgccgctgcggtcgcggcattgatattttggtatcagtggtttccctgtcctgagtggcaactgccgccggtattgcgtgcagttgtttccctcatccatctgcaactgggaatcacacttctgcttatgcccgtgcaaatcgtcatatttcatggcattagtctgacctcgtttattgcaaatctattagcaattcccttggtgacatttatcacggttccgttgatcctcgccgcgatggttgtgcatttaagcgggccgttaatcctggagcaagggttatggtttcttgccgaccggtctttggctttacttttctgggggttaaagagtttgccggaagggtggatcaacattgctgaatgttggcaatggctatcattttccccatggttcttactggtggtatggcgattaaacgcctggcgaacgttgccagcaatgtgtgtggctggaggcttgctgatgtgctggccgctgtggcaaaaacctcgacctgacgagtggcagctgtacatgcttgatgtcgggcaagggctggcaatggtgatagccagaaacggcaaagcgattctctatgacacaggactggcctggcctgaaggggatagtgggcaacaactgattatcccctggctccactggcataatcttgaaccggaaggcgttattctgagccatgaacatctggatcaccggggagggctggattcaatattgcatatatggccgatgttatggatcagaagtccgttaaactgggaacatcatcagccctgtgtgcgtggcgaagcgtggcaatggcaaggattgcgtttcagcgcgcactggcctttacaaggtagcaacgataaaggaaataaccattcctgtgtggttaaggttgatgacgggacgaatagcattcttctaaccggtgatattgaagccccagctgaacaaaagatgctaagccgttactggcagcaagtgcaggcaacattgcttcaggtacctcaccatggcagtaatacctcatcatcgttgccattaattcagcgagtgaatggaaaagtggcactcgcatcggcatcgcgctataacgcatggcgactgccctctaacaaagttaagcatcgctatcaactgcaaggatatcaatggattgatactccacatcaaggtcaaacaacggtcaatttttcagcgcaaggctggcggattagcagcctcagggagcaaattttacctcgttggtatcatcagtggtttggcgtgccagtggataacgggtagaatatgcggctatttcaacaaatgctggttttttgaatgcataacgacaaagatctctctacgtggcagacattccgccgactgtggccaaccattgcgcctttcaaagcgggtctgatcgtggcgggcgtagcgttaatcctcaacgcagccagcgataccttcatgttatcgctccttaagccacttcttgatgatggctttggtaaaacagatcgctccgtgctggtgtggatgccgctggtggtgatcgggctgatgattttacgtggtatcaccagctatgtctccagctactgtatctcctgggtatcaggaaaggtggtaatgaccatgcgtcgccgcctgtttggtcacatgatgggaatgccagtttcattctttgacaaacagtcaacgggtacgctgttgtcacgtattacctacgattccgaacaggttgcttcttcttcttccggcgcactgattactgttgtgcgtgaaggtgcgtcgatcatcggcctgttcatcatgatgttctattacagttggcaactgtcgatcattttgattgtgctggcaccgattgtttcgattgcgattcgcgttgtatcgaagcgttttcgcaacatcagtaaaaacatgcagaacaccatggggcaggtgaccaccagcgcagaacaaatgctgaagggccacaaagaagtattgattttcggtggtcaggaagtggaaacgaaacgctttgataaagtcagcaaccgaatgcgtcttcaggggatgaaaatggtttcagcctcttccatctctgatccgatcattcagctgatcgcctctttggcgctggcgtttgttctgtatgcggcgagcttcccaagtgtcatggatagcctgactgccggtacgattaccgttgttttctcttcaatgattgcactgatgcgtccgctgaaatcgctgaccaacgttaacgcccagttccagcgcggtatggcggcttgtcagacgctgtttaccattctggacagtgagcaggagaaagatgaaggtaagcgcgtgatcgagcgtgcgactggcgacgtggaattccgcaatgtcacctttacttatccgggacgtgacgtacctgcattgcgtaacatcaacctgaaaattccggcagggaagacggttgctctggttggacgctctggttcgggtaaatcaaccatcgccagcctgatcacgcgtttttacgatattgatgaaggcgaaatcctgatggatggtcacgatctgcgcgagtataccctggcgtcgttacgtaaccaggttgctctggtgtcgcagaatgtccatctgtttaacgatacggttgctaacaacattgcttacgcacggactgaacagtacagccgtgagcaaattgaagaagcggcgcgtatggcctacgccatggacttcatcaataagatggataacggtctcgatacagtgattggtgaaaacggcgtgctgctctctggcggtcagcgtcagcgtattgctatcgctcgagccttgttgcgtgatagcccgattctgattctggacgaagctacctcggctctggataccgaatccgaacgtgcgattcaggcggcactggatgagttgcagaaaaaccgtacctctctggtgattgcccaccgcttgtctaccattgaaaaggcagacgaaatcgtggtcgtcgaggatggtgtcattgtggaacgcggtacgcataacgatttgcttgagcaccgcggcgtttacgcgcaacttcacaaaatgcagtttggccaatgatcgaaaaaatctggtctggtgaatcccctttgtggcggctattgctgccactctcctggttgtatggcctggtgagtggcgcgatccgtctttgctataaactaaaactgaagcgcgcctggcgtgcccccgtaccggttgtcgtggttggtaatctcaccgcaggcggcaacggaaaaaccccggtcgttgtctggctggtggaacagttgcaacagcgcggtattcgcgtgggggtcgtatcgcggggatatggtggtaaggctgaatcttatccgctgttattgtcggcagataccacaacagcacaggcgggtgatgaacctgtgttgatttatcaacgcactgatgcgcctgttgcggtttctcccgttcgttctgatgcggtaaaagccattctggcgcaacaccctgatgtgcagatcatcgtaaccgacgacggtttacagcattaccgtctggcgcgtgatgtggaaattgtcgttattgatggtgtgcgtcgctttggcaatggctggtggttgccggcggggccaatgcgtgagcgagcggggcgcttaaagtcggttgatgcggtaatcgtcaacggcggtgtccctcgcagcggtgaaatccccatgcatctgctgccgggtcaggcggtgaatttacgtaccggtacgcgttgtgacgttgctcagcttgaacatgtagtggcgatggcggggattgggcatccgccgcgcttttttgccacgctgaagatgtgtggcgtacaaccggaaaaatgtgtaccgctggccgatcatcagtctttgaaccatgcggatgtcagtgcgttggtaagcgccgggcaaacgctggtaatgactgaaaaagatgcggtgaaatgccgggcctttgcagaagaaaattggtggtatttgcctgtagacgcacagctttcaggtgatgaaccagcgaaactgcttacgcaactaaccttgctggcttctggcaactagttacgccgcggcagcgttcgattgatggagtcatgaatgtcgctgccgcacctctcccttgctgatgcgcgtaatcttcaccttgccgcacaaggcctgttaaacaaaccccgccgtcgagcgtcgttggaggatattccggcaacgatctcccgcatgtccttgctgcaaatcgataccatcaatattgttgcccgtagtccatatctggtgcttttcagtcgtctgggaaattatcctgcccagtggctggatgagtctctggcgcgtggcgaattaatggaatactgggcgcatgaagcctgctttatgccgcgtagcgactttcgtcttattcgccaccgcatgctggcacctgaaaaaatgggctggaaatacaaagacgcctggatgcaggaacatgaggcggaaattgcacagttaattcagcatattcatgataaggggccggtacgttcagccgattttgagcatcctcgtaaaggtgcaagcggctggtgggaatggaagccgcataaacggcatctggaaggtttatttactgccggaaaggtgatggtgattgaacggcgcaacttccagcgcgtttatgatttaacccaccgtgtcatgcctgactgggatgatgagcgcgatctcgtttcgcaaacagaagcagaaatcatcatgctggataacagtgcgcgtagcctgggaatattccgcgaacagtggctggcagattactatcggctgaaacgtccggcactggcggcgtggcgcgaagcgagggctgaacagcagcaaatcattgctgtgcatgttgaaaaattgggcaatctttggctgcatgatgatttgctgccgctactcgagcgagcgctggccggaaagctcactgcaacgcacagcgcggtactttcgccttttgatcctgttgtctgggatcgcaaacgcgcagagcagctttttgattttagctaccggctggagtgctataccccagcgccgaaacgccagtatggctattttgttctgccgttattacatcgtgggcaattagttgggcgaatggatgccaaaatgcatcgccagacaggcatccttgaagttatctctctgtggttacaggaaggtattaaaccaacgacaacgctgcaaaaagggctacgtcaggcgattactgatttcgctaactggcagcaggcaacgcgggtgacattaggatgctgcccgcaaggcctctttactgattgccgcaccggctgggaaatagaccccgtcgcataaatgattatgataagatttatgcattcataacccgatccatctggaggaactatggatcatcgtctgcttgaaatcattgcctgcccggtttgcaacggaaaactttggtataaccaggaaaaacaagagcttatttgcaaactggacaacctcgctttcccgctgcgtgatggcattccagtgttgctggaaacggaagcccgcgtgctgactgctgatgagagtaaatcatgagttttgtggtcattattcccgcgcgctacgcgtccacgcgtctgcccggtaaaccattggttgatattaacggcaaacccatgattgttcatgttcttgaacgcgcgcgtgaatcaggtgccgagcgcatcatcgtggcaaccgatcatgaggatgttgcccgcgccgttgaagccgctggcggtgaagtatgtatgacgcgcgccgatcatcagtcaggaacagaacgtctggcggaagttgtcgaaaaatgcgcattcagcgacgacacggtgatcgttaatgtgcagggtgatgaaccgatgatccctgcgacaatcattcgtcaggttgctgataacctcgctcagcgtcaggtgggtatggcgactctggcggtgccaatccacaatgcggaagaagcgtttaacccgaatgcggtgaaagtggttctcgacgctgaagggtatgcactgtacttctctcgcgccaccattccttgggatcgtgatcgttttgcagaaggccttgaaaccgttggcgataacttcctgcgtcatcttggtatttatggctaccgtgcaggctttatccgtcgttacgtcaactggcagccaagtccgttagaacacatcgaaatgttagagcagcttcgtgttctgtggtacggcgaaaaaatccatgttgctgttgctcaggaagttcctggcacaggtgtggatacccctgaagatcttgagcgcgttcgcgctgaaatgcgctaatttcacttcacgacacttcagccaattttgggaggagtgtcgtaccgttacgattttcctcaatttttcttttcaacaattgatctcattcaggtgacatcttttatattggcgctcattatgaaagcagtagcttttatgagggtaatctgaatggaacagctgcgtgccgaattaagccatttactgggcgaaaaactcagtcgtattgagtgcgtcaatgaaaaagcggatacggcgttgtgggctttgtatgacagccagggaaacccaatgccgttaatggcaagaagctttagtacgcccggaaaagcccgacaactggcatggaaaaccaccatgctggcaagaagtgggactgtccgtatgccgactatttatggtgtgatgacgcatgaagaacaccccggccccgatgtcctgctactggagcggatgcgtggtgtttcggtggaggcaccagcccgaacaccagaacgctgggaacaactcaaagaccaaatcgttgaagccttactggcctggcaccgtcaggacagtcgcggttgcgtcggcgcggtcgacaatactcaggaaaatttctggccctcatggtaccggcaacatgttgaagtgctatggaccacgctcaatcagttcaataacaccggtctgacgatgcaggataagcggatcctgtttcgcactcgcgaatgtctcccggcattatttgaaggctttaacgacaattgtgtgctgattcacggtaacttctgtttacgcagcatgttgaaagattcgcgcagcgatcagttactggcgatggtcgggccgggactaatgctttgggcaccgcgagaatacgaactgttccgactaatggataattctctggcggaagatttgctctggagttacctgcaacgcgcgccagtggcggagtcgttcatctggcggcgttggttgtatgtgttatgggatgaagttgcgcaactggttaataccggacgatttagtcggcgcaacttcgatctggcatcaaaatcactcttgccgtggctcgcctgacgaaccttttagccactgccagatacggccaagcgtttcatagccaacacgatcgctatgcatcaaccagaccggagaagggattgcccgttcccacgggttaagcggcgagtcgatggccaactgattcgccggggctggtagcggatttaacccttcctgctgaaaaaagatcatcgcccgcggcagatgtgatgcggaggtcaccagcaggaaaggggcgtcaccaatcgcctgtttcactgctgcagcttcttcttcggtatcttttggcaaatccagggtgataatttgctcgcgcggcacgcccagcgattgcgcaactctggcacctacttccgctgtactcaccgtattggtttttgctacgcctcccgtgaagatcagttttgatcccggattttcgcgccataagcgaataccttcattcaggcgtggcagactgttattgattaaattagagctcggtgcccactgcgggttccaggtataaccacctccgagcaccacgatatagtccactttttgcgaattattccatgtcggataggtgctttcgatgggacgcagcaggcggtcggctaccggttgcaaactcaataacaagagcgccagccacccaatgctaataaaaatcttcccggttttttgaaaacggctaaaccacagcagcgccaggccagcgccaataatcaacaacatcagcggaagtggcagcaacatattgccaatcacttttttcagtgtaaaaagcatcctttctggttccttttttaaccatatagcaagggatcgccagcgatattacaccagacgggttcattctcgccgtggctgtgacaaaatagcgtctttatcagaaaacgtcttagccaaccggtggagaaagcaatgcaggatcgcaattttgatgatattgcggaaaagttttcccgtaacatttacggcaccaccaaagggcagcttcgacaggctattctgtggcaggatctcgatcgcgtgctggcggaaatgggcccgcaaaaactgcgtgtgctggatgctggcggtggagaagggcagaccgcaatcaaaatggccgagcgtgggcatcaggtcattttatgcgatctttctgcgcagatgatcgaccgcgcaaaacaggcggcagaagcaaaaggtgtgagcgacaacatgcaatttatacattgcgccgctcaggatgttgcttcgcatttggaaacgcccgttgatctgatattgttccatgcggtgctcgagtgggtggctgatccccgcagcgtattgcagaccctctggtcagtgttgcgtccaggcggcgtgttgtcgttaatgttctacaatgcgcatggtttgttgatgcataacatggtcgccgggaattttgattacgtgcaggcgggaatgccgaaaaagaaaaaacggacgctttcgccagattatccacgcgacccggcgcaggtttatctgtggctggaagaagctggttggcaaattatgggtaagacaggcgttcgcgtgtttcatgattatctgcgcgagaaacaccagcagcgcgactgctatgaagcattacttgaattagaaacgcgttattgccgtcaggaaccgtatattaccctggggcgttatattcatgtcaccgcgcgcaaaccgcagagcaaggataaagtatgagtgaattttcccagacagtccccgaactggttgcctgggccagaaaaaatgacttctccatctcgctgccggtagaccgactctcttttctgctggcggttgccacgctgaacggcgagcgtctggatggtgagatgagtgaaggcgagctggtggatgcattccgccatgtgagtgatgcgtttgagcaaaccagcgaaaccatcggcgtgcgcgccaataacgcgatcaacgacatggtgcgtcaacgtctgctgaaccgctttaccagcgagcaggcggaagggaacgcaatttaccgtctgacgccgctcggcatcggcattactgactactacatccgtcagcgcgagttttctacgctgcgtctttctatgcagttgtcgattgtggcgggtgagctcaaacgcgcagcagatgccgccgaagagggcggtgatgaatttcactggcaccgtaatgtctatgcgccactgaaatattcggtagcagaaattttcgacagtatcgacctgacgcaacgtctgatggacgaacagcagcagcaggtgaaggacgatatcgcccagttgctgaacaaagactggcgggcggcgatttccagctgtgaattgttgctttcggaaacttccggaacgctgcgtgaattgcaggatacgctggaagcggcaggcgacaaattgcaggctaatctgttgcgcattcaggatgcgacgatgacccatgacgatctgcatttcgtcgatcgtctggtgttcgatctgcagagcaaactcgatcgtattatcagttggggccagcaatccatcgacttgtggattggctacgaccgccacgtacacaaatttattcgtaccgcgatcgatatggataaaaaccgcgtctttgctcagcggttacgtcagtcggtacaaacctattttgatgagccgtgggcgctaacttatgccaatgccgatcgtctgctggatatgcgtgacgaagagatggcactgcgcgatgaagaagtgactggggaacttcctgaggatctggaatacgaagagtttaacgagatccgcgaacagctggcggcgatcatcgaagaacaacttgccgtgtacaaaaccagacaagtgccgctggatcttggtctggtggtacgcgaatatctgtcacagtatccgcgtgcacgtcactttgacgttgcgcgtattgttattgatcaggcggtacgtcttggcgtagcgcaagcagatttcaccggactgccagcgaaatggcagccgattaatgattacggagccaaggtacaggcgcatgtcatcgacaaatattgaacaagtgatgccggttaagctggcgcaggcgctggcgaatccgttatttccggcgctggacagcgccttacgttcaggacgccatattggcctcgacgaactggataatcatgcattcctgatggattttcaggaatatctggaagagttttacgcgcgttataacgttgagcttattcgcgcaccagaagggttcttctatttacgcccacgttccaccacgctgatccctcgttccgtcttgtcggaactggatatgatggtcgggaaaatcctctgttatctctatctcagcccggaacggctggcgaatgaggggattttcacccagcaggaactgtacgacgaactgctcaccctggccgatgaagcaaaactgctgaaactggtgaacaaccgttcaaccggttcagacgttgaccgtcagaagttgcaggagaaagtacgttcttcgctcaaccgtctgcgtcgtttaggcatggtgtggtttatgggccacgacagcagcaagtttcgcattaccgaatcggtgttccgcttcggagccgatgtgcgtgctggcgacgatccccgtgaagcacagcgtcgcctgattcgtgatggcgaagcaatgccgattgaaaatcatctgcaactcaacgatgaaaccgaagagaatcagccagatagcggagaggaagaataatgattgaacgcggtaaatttcgctcactgacgctgattaactggaacggcttttttgcccgaacttttgaccttgacgagctggtcacgacgctttctggcggtaacggggcgggtaaatccaccaccatggcggcgttcgttacggcgctgatccccgacctgaccctgctgcatttccgtaacactacggaagccggggccaccagcggttcgcgcgataaaggtctgcacggtaagctgaaagcgggtgtctgttattcgatgctcgacaccattaactcgcgccaccagcgcgtggtggtcggtgtgcgtctgcaacaggttgccggacgcgatcgtaaagtggatatcaagccgtttgccattcagggactgccgatgtcggtgcagccgacacagctggtgaccgaaaccctgaacgaacgccaggcgcgcgtgctgccgcttaacgagctgaaagacaagctcgaggcgatggaaggcgtgcagtttaaacagttcaactccattactgattaccactcgctgatgttcgatctgggcatcatcgcgcgtcgtctgcgctccgcatctgaccgtagcaaattctatcgtctgatcgaagcttcgctgtatggcgggatctccagtgccattacccgttctctgcgcgactacctgttgccagaaaacagcggcgtgcgtaaagcgttccaggacatggaagcggcgctgcgtgaaaaccgtatgacgctggaagcgattcgtgtcacccagtcggaccgcgacctgtttaagcatctgatcagcgaagccaccaactacgtggcggcggactacatgcgtcacgccaacgagcgccgtgtccatctcgacaaagccctggagtttcgtcgcgagctacatacttcgcgtcagcaactggcggctgagcagtacaaacacgtcgatatggcgcgtgagctggcagagcacaacggtgccgaaggcgatctggaagcggattatcaggcggccagtgatcacctgaacctggtgcaaaccgcactgcgtcagcaggagaagatcgaacgctacgaagcggatctcgatgagctgcagatccgtctggaagagcaaaatgaagtggtggcagaagccatcgaacgccagcaagagaatgaggctcgtgcggaagctgccgaactggaagtggacgagctgaaaagccagcttgctgactaccagcaggcgctggacgtccagcaaacgcgcgcgatccagtataaccaggcgattgctgcgcttaatcgtgccaaagaactgtgccatctgccggacttaaccgccgactgcgccgccgaatggctggaaaccttccaggcgaaagagctggaagcgactgaaaaaatgctctctcttgagcagaaaatgagcatggcgcaaaccgcgcacagccagtttgagcaggcttatcagctggtggtggcaatcaacggcccactggcgcgtaacgaggcgtgggatgtcgctcgcgaactattgcgcgaaggggtcgatcagcgtcacctggcagagcaggttcagccgctgcggatgcgattaagcgaactggaacagcgtctacgcgagcagcaagaagctgagcgtctgctggcagatttctgcaaacgtcagggcaagaattttgatatcgacgaactggaagccctgcatcaggaactggaagcacgcattgcctctctttccgatagcgtgtctaacgcccgtgaagagcgcatggcactgcgccaggagcaggaacagctgcagtctcgcattcagagtttgatgcagcgtgcgccggtttggctggcagcgcaaaacagtctcaaccagttgagcgaacagtgcggcgaagagtttacctccagccaggacgtcaccgaatatctgcaacagttgctggagcgtgagcgagaggcgattgttgaacgcgatgaagtgggcgcgcgcaaaaacgccgtcgatgaagagatcgaacgtttaagccagcctggcggctctgaagatcagcgtctgaacgcgctggcggagcgttttggtggtgtgctgctgtcagaaatttatgacgacgttagcctggaagatgcgccgtacttctcagcgctgtatggcccgtcacgccacgccatcgtggtgccagatctgtcacaggtaactgaacacctggaaggcttgaccgattgcccggaagatctctatctgatcgaaggagatccgcagtcattcgatgacagcgtgttcagcgttgatgagctggaaaaagcggtagtggtgaaaatcgccgatcgtcagtggcgttattcacgtttcccggaagtgccgctgtttggtcgtgctgcgcgtgaaagccgtattgaaagcctccatgccgagcgtgaagtgctttccgaacgcttcgccacgctctcctttgatgtacagaaaactcagcgtctgcatcaggcgttcagccgctttatcggcagtcatctggcggttgcgtttgagtctgacccggaagcagaaatccgtcaactgaacagccgtcgcgtcgaactggagcgggcgttaagtaatcatgaaaatgataaccagcagcagcgtattcagtttgagcaggcgaaagagggcgttacggcgctgaaccgcattctgccgcgtctcaacctgttggctgatgacagcctggcggatcgcgtcgatgaaatccgcgaacgtctggatgaagcccaggaagccgcgcgttttgttcagcagtttggcaatcaactggcgaaactggaaccgattgtttcggtattgcagagcgacccggaacagttcgaacagttaaaagaagattacgcgtactctcagcagatgcagcgcgatgcccgtcagcaggcgtttgccctgacggaagtggtgcagcgtcgtgcgcactttagctattctgactcggcagaaatgcttagcggtaacagcgatctcaacgaaaaactgcgtgaacgtctggaacaggcggaagcggagcgtacccgcgctcgcgaagcgttgcgcggtcacgcagcgcagttgagtcagtacaaccaggtgctggcttcgctgaaaagttcttacgacaccaaaaaagagctactcaacgatctgcaacgtgaattgcaggatatcggcgtgcgtgctgatagcggggcagaagagcgggcgcgtattcgccgtgacgagctgcatgcgcaactgagcaataaccgttcacgccgcaatcaactggaaaaagcgcttaccttctgcgaagcggagatggacaacctgacccgcaaactgcgcaagctggagcgggattactttgagatgcgcgagcaggtagtgaccgccaaagcgggctggtgtgcggtgatgcgcatggtgaaagataacggcgttgagcgccgcttacaccgtcgtgagctggcttatctctccgctgatgatttgcgttccatgtcggataaggcgttaggtgcgctgcgtctggcggtggcggataacgaacatctgcgcgacgtgctgcgcatgtcggaagatccgaaacgtccggagcgtaaaattcagttcttcgtggcggtttatcagcatctgcgtgaacgtattcgtcaggatattattcgtaccgatgatccggtggaagctatcgaacagatggagattgaacttagccgtctgaccgaagaattaacctcccgtgaacagaaactggcgatcagttcccgcagcgtggcgaacatcattcgcaaaaccattcagcgcgagcagaaccgtatccgtatgctcaaccaggggttgcagaacgtatcgtttggtcaggtgaacagcgtgcgtctcaacgtgaacgtgcgtgaaacgcacgccatgctactggatgtgctctctgaacagcacgagcagcatcaggatctgtttaacagcaaccgtttgaccttctcggaagcgctggcgaaactgtatcaacgtcttaacccgcagattgatatggggcagcgcacgccgcagaccatcggtgaagaactgctggattaccgcaactatctggaaatggaagttgaggttaaccgtggttccgatggctggctgcgcgcagagtctggtgcattgtcgaccggtgaggcgattggtaccggtatgtcgattctggtgatggtggtacaaagctgggaagatgaatctcgccgcctgcgcggtaaagatatctctccttgccgcctgctgttcctcgatgaagcagcgcgactggatgctcgttctatcgccacgctgtttgaattgtgtgagcgtttgcaaatgcaactcatcatcgcagcgccggaaaatatcagcccggagaaaggcaccacctataaactggtgcgtaaagtcttccagaataccgaacacgttcatgtcgtcggcctgcgaggatttgcgccgcaactccctgaaacgcttccaggaactgacgaagcgccttctcaggcgagttaaaattaaggcggcagcaatgccgccttttctttttccgaaaactccgtttctgcactaaaaaagtggcacattacggcgcgcttttctttaaacttctttacattaggttatgtaaaaacgtatcggcgtttatatactgaagataagcctgatgagtaacaggcttgctcgtcatactttcgtgagtattggcgttgtacaggcaagtcgtaaaataacagcctggctattcagagtatgataaaaacagggggcaagggatgttgcttaatatgatgtgtggtcgtcagctgtcggcaatcagtttgtgcctggccgtaacattcgctccactgttcaatgcgcaggccgatgagcctgaagtaatccctggcgacagcccggtggctgtcagtgaacagggcgaggcactgccgcaggcgcaagccacggcaataatggcggggatccagccattgcctgaaggtgcggcagaaaaagcccgcacgcaaatcgaatctcaattacccgcaggttacaagccggtttatcttaaccagcttcaactgttgtatgccgcacgcgatatgcaacccatgtgggaaaaccgtgatgctgttaaagccttccagcaacagctggcagaggtggcgattgccggtttccagccgcagtttaataaatgggtagagttactgaccgatcctggtgttaacgggatggcacgcgacgtggtgctctctgatgcgatgatgggctatctccatttcattgcaaatattccggtcaaaggcactcgctggctatatagcagtaaaccttatgcacttgcaacgccgccgctctcggtgattaaccaatggcagctggcgctggataaaggtcaattgcctacgtttgttgcaggactggcaccgcagcatccgcaatatgcggcgatgcatgaatcgttactggccttactctgtgacaccaaaccgtggccccaactgaccggcaaagcaacgttgcgcccagggcagtggagtaacgacgtaccggcgttgcgcgaaatattgcaacgcacaggcatgttggacggggggccgaaaattactctacctggcgatgacacgccaactgacgcggtagtcagcccatccgctgttactgttgaaacagcagaaactaagccgatggataagcaaacgacgtctcgtagtaaacctgcgcctgccgttcgcgccgcctacgataatgaactggtggaagccgttaaacgttttcaggcatggcaaggattgggggcagatggtgctattggcccggcaacacgtgactggttaaacgtaacgcccgcccagcgtgctggtgtgttggctctcaacatccagcgattgcgcttgctgccaacagagctttctaccgggatcatggttaacattccggcctattcgctggtctactatcagaacggcaatcaggtgctggattcgcgagtcattgtcggtcgccccgatcgcaaaacgccgatgatgagcagtgcccttaacaacgtagtggtaaacccgccgtggaacgtacctccaactctggcacgcaaagatattctgccaaaagtgcgcaacgatccgggatatctcgaaagccatggctatacggtgatgcgcggctggaacagcagagaagcgattgacccatggcaggttgactggtctacaatcacggcctcgaatttaccgttccgcttccagcaggctccaggcccacggaactcgctggggcgctataaattcaatatgccgagttcagaggccatttatttgcatgacacgccgaaccacaatctgttcaagcgtgatacacgcgcattgagctcaggctgtgtacgagtgaataaagcttccgatctggcgaatatgctgttgcaggatgcaggctggaatgacaaacgtatttctgatgcgctgaagcagggtgatacacgttacgtcaatattcggcagtcgattccggtgaatctctactacctgacggcctttgttggtgcagatggtcgtacccagtatcgtacagatatttacaattatgatctgcctgcgcgatccagctcgcaaatcgtatcgaaagcggaacaattaatcaggtaaatgaagtagttcggggaaatcagttgtcgtaataattagcatgattgggggcgattctctgcagcccccgtcactgctggggttgagtcatcttgacgtctgctttacgggcggttaaggtgcctcttgtgcgccagaagtgcatataaacgataacattgacctgtagacttgattatcatggacaaattcgacgctaatcgccgcaaattgctggcgcttggtggcgttgcactcggtgccgccatcctgccgacccctgcgtttgcaacactctctaccccacgcccgcgcattttgacactcaataatcttcataccggagagtcaatcaaagcggagtttttcgatggcagaggctatattcaggaagaattggcaaaacttaaccattttttccgcgattaccgcgcgaacaaaataaagtccatcgacccaggattattcgaccagttgtatcgcctgcaagggttgttaggcacgcgcaaaccggtgcaactcatttccggttatcgttctattgataccaacaatgaactacgcgcccgcagccgtggagtagcgaagaaaagctatcacactaaaggccaggcgatggatttccatattgaaggtatcgcgttaagcaatattcgcaaagccgcgttatctatgcgcgcaggtggtgtaggatattatccacgtagtaactttgtgcatattgataccgggccagcacggcactggtagtaattgcttaacgaaacaggggcagtatgaactatcgtattattccggtcaccgcattctcccagaactgttcattaatctggtgtgaacaaacccgtctggccgcactggtcgatcctggcggcgatgcggaaaaaatcaaacaggaagttgatgacagcggcctgacactgatgcagatcctgctgacgcatggtcatctggaccacgttggcgcagcggcggaactggcgcaacattacggcgtgccggttttcggcccggaaaaagaagatgagttctggctgcaaggcttgcctgcgcaaagtcgtatgtttggtctggaagagtgccagccgctgacgccagatcgttggctgaacgaaggcgataccatcagcatagggaatgtgactttacaggtgttacattgccctgggcatacgccgggtcatgtcgtgttttttgatgatcgggcaaagctgctgatttctggcgatgttattttcaaaggcggagtagggcgcagtgacttcccgcgtggcgatcataatcaactgatttcttcaatcaaagataaattgctgccactgggggatgacgtgatatttattccgggtcacggaccattatccacacttggttatgaacgcctgcataatcccttcctgcaagacgaaatgcccgtctggtaaggcacataaaaaagcccgcttttaatgctggcctggatttctggcaaagtgcgctttgtttatgccggatgcggcacgagcgccttatccggcctacaaaatcgtgcaaattcaaaatattgcaggggacgcgtaggcctgataagcgtagcgcatcaggcaatgttgcgtttgtcatcagtctcagcccgcttttcagcgggcttcattgtttttaatgcttacagcactgccacaatcgcttcgcacagcggagccatgttatctggtgtcatcccggccacatttacgcgaccagaagcaaccgcatatacgccaaactcttcgcgcagacgcagcacttgttcttttgtcaggccactgaaggagaacatgccgttctgtttgatgataaagctgaagtcgcggtttgcgcctttttcctgcagcgtattgacgaacaactgacgcatacgctgaatacgctggcgcatatcagtcagctcttgttcccaaatcgcacgtaacgcatcgttgctcaggatggtggcaacaacagaagcgccgtgtgctggtgggttagagtagttagcgcgaatcgccgctttcatttggctgaatgcgcgatcaacggtttcactgtcggcagcaaccagagtacaagcgccaacacgctcgttgtacaggccaaagtttttagagtaggaactggcaacaatcagctctttatgcatagccgcgaaagcgcgcagtccttcagcatcttcttccagaccacgggcaaaaccctggtaagcgaagtcaaacagcggtaaccagcctttctcaacggagagttgtgccagtgtttgccattgttccagcgtagggtcgataccggttgggttatggcagcagccatggaacagcactacgtcgccagcctgagcttcattcaggctgttaatcagtgcatcgaagtcaagagtgtgattttccgcatcataataagcgtattcacgaacttccagacctgcagagttaaagacgctcttatggttcggccagcttgggttgctcacccacacacgcttaacgctggtattttttgccaggaaatcggcagccacgcgtagtgcgccagtgccccccggagtctgtgccgtgcgagcacgtttgtcattgatcagggcgctacctttaccaaacagcagttcctgagtgcagcgaccaaattcagggatgccgtcaatgccgaggtaatttttggtggtttcattttcgagcagatactgttcagcctttttcacgctggtcagtaccggggttttgcccgtctcatctttatagacaccaatcccgaggttaattttgccgggacgttcatcggcacgaaacagatcggccaggcccagaatcgggtcggcaggagcggcggtaatgttctcaaacatgacgaggttccattatggttacagaagggaagtccgctatcagggtaacgggagatttacaaaattccaactattactgatgaaaacgcaggctgtttttgcaagacgtgagattgctctggaaggtataaaaaaaacaggaccaaagtcctgttttttcggcatttaacaaagaggtgtgctattagaactggtaaacgatacccacagcaacggtgtcgtctgaacctacgcccagtttgttgtcagaatcgatctggttgatgatgtagtcaacataggtggacatgtttttgttgaagtagtaggttgcgcccacttcaaagtagttcaccagatcaacatcaccgataccttctacgtctttcgctttagatttggtgtaagcgatggacggacgcagaccgaaatcgaactggtattgcgcaactaacagaacgtcttgcgttttgttggcgaagccgctggtgtttgtaaatttattagtgatcggcgtagcgttacgggtttcaccgtagttcgctgccaggtagatgttgttcgcgtcgtacttcagaccagtagcccactgttcagcttttttaccgttgccaagaggttgagcttcttgcaggttggtacggtcagctgcaccataagcaccaacgataccaaagccttcgtattcgtagctgatagaaccgccaacaccgtcgccgttagaacggcgtgcagtgtcacgctcgtttttacccaggtactgaacagcgaagttcaggccatcaaccagaccaaagaagttggagttacgataggtagcaacgccgccaacacgaccaacgaagaagtcatcgctgtatgcagtatcaccaccaaattctggcagcatatcggtgtaacccagtgcatcataaaccacaccgtagttacggccgtaatcgaaagaaccaacgtcagcgtatttaagacccgcgaatgccagacgcgttttgttaccagtttgagcgtcagcgccttcagagttgttaccctggaagttatattcccactgaccataaccggtcagatcggaattgatttgagtttcccctttaaaaccaagacgggcataggtcatgtcgccattgccaccgtaactgttttcaccgttacccttggaaaaataatgcagaccaacagctttaccgtacagatctactttgttgccatctttgttatagatttctgcagcgtttgcagtacctgctactaacagagcagggacgatcactgccagaatattgcgcttcatcattatttattaccctcatggttttttttatgacacctgccactgccgtcaataagttctgtcaataaaaatttacggaactattgatgagagtttggtgtctttatgtgtctgcaggcatctttccattcaaactaacgtttcgctaccgtgaaagtgctacaaagataaagatttggtttcaaaaagaaaaaatatgtaaccaaaagtaaaatttaaggaactttgtgaacaccgtcatatttccatagagacgtgatgatatttacagcaattttaatctatttatatgatttccttatatttaaattaactaaacggaaattttgtttctgatggaaactttatcgacctggcacaaaatcttctttcagacatccagaatgccaaaaaatagtatgaaaattgtgctattagctaagaaaaaactaatccgcaataagaatgcggattagtttttgcgcgtaaatgttgcaatgtaatattccgtaacaggatgatcgttatggcggggttgcaaatagattgcttgacttaacaaacagataacttgacagaaaagataaaaaaagagccagcgggcgctggctcttgaagacgctaaattagaagctggcgttacgcggagtacgtgggaacggaatcacatcacgtacgttttgcacgccagttacgtaagcaatcagacgttcaaaaccaagaccgaaacctgaatgcggaacagtaccgtagcgacgcagatcgcgataccaccagtaatcttctttattcaggcccatttccagcatacgctcgtccagcacgtccagacgttcttcacgctgggagccaccaatgatctcaccgatgcccggagccagaacgtccatagccgcaacggttttaccgtcttcgttaaggcgcatatagaacgctttaatatctttcggatagtttttaaccactaccggtgctttaaagtgttcttccgccagataacgctcatgctcagaagagagatcgactccccagtaaaccgggttttcaaacttcctgccgcagttttcgagaatggtcactgcgtcggtataatccacctgcgcaaaatcggcttcaatgaagcgttccagacgtgaaacggcatctttatctacgcgttcagcgaagaatttcatgtcgtcagcgcgttcttcgagaaccgctttgaagacatatttcagcatggcttcagccagacccgcaatatcgttcaggttagcaaacgccacttccggctccagcatccagaattccgccaggtgacggctggtgttggagttttcagcacggaaagtcgggccgaaggtataaattttggacaatgcgcaagcgtaggtttcgccgttcaactggccagatacggtcaggaaagactctttaccaaagaagtctttgtcgaaatccactttgccctgatcgttacgcggcaggttttccagatccagcgtagaaacgcggaacatttcgcctgcaccttcggtatcagatgcggtaatcagtggcgttgaaacccagaagaatccctgctcgttaaagaagcgatgcagcgcctgcgccagcgtatggcgaacgcgcgcgacggcaccaatcaggtttgtgcgcggacgcaggtgagcgacttcacgcagatactcaatgctgtggcgttttgccgccatcgggtaagtgtctggatcttcaacccaaccagcaacttcaaccttgctggcctgaatttcaaattgttgcccctggcccggcgacgccacgactttacccgtcacaatgaccgagcagccggtggtcagacgcaggacgtcttcattgtaattgggcagagaattattgatgacagcctgtacaggatcaaagcaggaaccgtcataaacggcgaggaaggagatgccagcttttgaatctcggcgggtacgtacccatccgcgcacggtgacttcgctgtcaacggctacacggccctggagtacgtcggctacaggcacaacgctcataatattctctctgttaatagtcggaaaaaataaacacttgtccacccgtaaatggggggatacctatgttacctggcatctgcaatcagacaagcagaattcgcaaatgcagcgaaagatttcggaattaaaggtaaaaaaagggagccgattagctccctgatgatattaactggcttttttaatatgcggaaggtcgaacgctttgcgcagcgcccgaacaaacgctttatcatggcagatagttttgccagggctgtcagaaagtttcgccaccggtttaccgttacactctaccaacttaatgacaatattcaggggttttacctgggggatatcgcaggtcaggcgagtcccaataccaaaacttaattgcacgcgggaagagaagtggcggtatagctcaaccgctttgcgtaaatccagattgtcagagaaaaccagcgttttactctgtggatcaattcccagcttttcataatgtgcaatggctttttcaccccattcaaccgggtcgccagagtcatgacgcaggccctgataccgactagcgaactcgacaccgaaatcacgcaggaaagcatccatagtgatgcagtcggttaatgcaatgccaagttggtcgggatactcttccagccaggcagcaagtgcagctcgctggctgttggctagatccgggctgatttgctgatgtgcctggaaccattcgtgtgcctgtgttcccatcggcgtgagggaaagccgacgcgccagatcgtagttgctggtgcccacaaaccaggattcctgttgcagacgcttaacgatggtttcttgtacttcgcgagaaaaacggcgacgggtgccaaaatccatcagatggaagcgcgacatatcaagaccggcggttaacgccgagaagtcgactaatttgctttccagcgtgtcgagggcttgcgcaacgtcggcctgcggtgagcgatagcgatgtaccatttcactgataaccgccagcaaaggaacttcccagaggatgacttcacgccacgggccgcttaaacgaatatccagcttgccattatcgttggacacggtgacttgttccgggttaaagcggaactcgcgtaaccagttaagatagtcggccttaaagaaaggcagggcagaaagccactgatattcatcatcctgcaggcgcaggtgctgcatcgcctgaacctgttcacgaatagcatcggcataaatacccagcagatcgtcacctcggcaacgaaactccgccgcgacatgcacatcgtaatagtgatgaaacacggcttgctgcatatgcaacttataagcatctgtatccagcaacgagtgcagaacaggagaagcgaattgtgtcataggtgcgcagtagcgtcctcgtacaggagcgtttagtacaataaacatcttcaggaactgctggagtataccttgtttcgcaatttattgaaccccgatcacaccatatgccacctttctggtcgatggcattacgcggtgtatgttataaaaatgtagcaataaaggcgtttgtacctgaaaagatgaagattctgcatagcgcgatttacgcaacaggaatagactgaacaccagactctataaaagatgctaaaggttatttatgactcaacagccacaagccaaataccgtcacgattatcgtgcgccggattaccagattactgatattgacttgacctttgacctcgacgcgcaaaagacggtcgttaccgcggtcagccaggctgtccgtcatggtgcatcagatgctccccttcgtctcaacggcgaagacctcaaactggtttctgttcatattaatgatgagccgtggaccgcctggaaagaagaagagggcgcactggttatcagtaatttgccggagcgttttacgcttaagatcattaatgaaataagcccggcggcgaataccgcgctggaagggctttatcagtcaggcgatgcgctttgcacccagtgtgaagccgaaggtttccgccatattacgtattatctcgaccgcccggacgtgctggcgcgttttaccaccaaaattattgccgataaaatcaaatatcccttcctgctttccaatggtaaccgcgttgcgcaaggcgaactggaaaacggacgccattgggtacagtggcaggacccgttcccgaaaccgtgctacctgtttgcgctggtggcaggcgactttgatgtactgcgcgatacctttaccacgcgttctggtcgcgaagtagcactggagctgtacgtcgatcgcggcaaccttgatcgcgcgccgtgggcgatgacctcgctgaaaaactccatgaaatgggatgaagaacgctttggcctggagtatgacctcgacatctatatgatcgtcgcggtggatttcttcaatatgggcgcaatggagaataaggggctgaatatctttaactccaaatatgtgctggcccgcaccgacaccgccaccgacaaagattacctcgatattgaacgcgttatcggccatgaatatttccataactggaccggtaaccgagtgacctgtcgcgactggttccagctcagcctgaaagaaggtttaaccgtcttccgcgatcaggagttcagctctgaccttggttcccgcgcagttaaccgcatcaataatgtacgcaccatgcgcggattgcagtttgcagaagacgccagcccgatggcgcacccgatccgcccggatatggtcattgagatgaacaacttctacaccctgaccgtttacgagaagggcgcggaagtgattcgcatgatccacaccctgcttggcgaagaaaacttccagaaagggatgcagctttatttcgagcgtcatgatggtagtgcagcgacctgtgacgactttgtgcaggcgatggaagatgcgtcgaatgtcgatctctcccatttccgccgttggtacagccagtccggtacaccgattgtgaccgtcaaagacgactacaatccggaaaccgagcagtacaccctgaccatcagccagcgcacgccagccacgccggatcaggcagaaaaacagccgctgcatattccgtttgccatcgaactgtatgataacgaaggcaaagtgatcccgttgcagaaaggcggtcatccggtgaattccgtgctgaacgtcactcaggcggaacagacctttgtctttgataatgtctacttccagccggtgcctgcgctgctgtgcgaattctctgcgccagtgaaactggaatataagtggagcgatcagcaactgaccttcctgatgcgtcatgcgcgtaatgatttctcccgctgggatgcggcgcaaagtttgctggcaacctacatcaagctgaacgtcgcgcgtcatcagcaaggtcagccgctgtctctgccggtgcatgtggctgatgctttccgcgcggtactgcttgatgagaagattgatccagcgctggcggcagaaatcctgacgctgccttctgtcaatgaaatggctgaattgttcgatatcatcgacccgattgctattgccgaagtacgcgaagcactcactcgtactctggcgactgaactggcggatgagctactggctatttacaacgcgaattaccagagcgagtaccgtgttgagcatgaagatattgcaaaacgcactctgcgtaatgcctgcctgcgtttcctcgcttttggtgaaacgcatctggctgatgtgctggtgagcaagcagttccacgaagcaaacaatatgactgatgcgctggcggcgctttctgcggcggttgccgcacagctgccttgccgtgacgcgctgatgcaggagtacgacgacaagtggcatcagaacggtctggtgatggataaatggtttatcctgcaagccaccagcccggcggcgaatgtgctggagacggtgcgcggcctgttgcagcatcgctcatttaccatgagcaacccgaaccgtattcgttcgttgattggcgcgtttgcgggcagcaatccggcagcgttccatgccgaagatggcagcggttacctgttcctggtggaaatgcttaccgacctcaacagccgtaacccgcaggtggcttcacgtctgattgaaccgctgattcgcctgaaacgttacgatgccaaacgtcaggagaaaatgcgcgcggcgctggaacagttgaaagggctggaaaatctctctggcgatctgtacgagaagataactaaagcactggcttgataaataaccgaatggcggcaatagcgccgccattcggggaatttacccctgttttctcaggcgagtttcagattcaccacgttgcatcacccgttgcaacacctccgcttccagctccgctaatcgcaccgaccctaatcgacgcggacgggggatatccactgtcaaatccagaccaatttttccctcttcaattaacagcacccggtcagccatcgctaccgcttcgctcacatcatgcgtcaccaacagtacggtaaagccgtgctcctgccaaagtgacacaatcaaatcctgcatctcgagtcgcgttaaggcgtccagcgccccgagcggttcatcaagcaacaataatcccggtcgatgaatcaacgctcttgccagcgccactcgctgtttctgcccgccagaaagtgcggcaggccattcccctgcgcgattctccagtcctaccgcagccaacgctcgacgtgcggcatcgcgccactggcctttaaggcctaacccaacgttatcaatcaccgatttccacggtagcagacgcgcatcctgaaacatcattcgcgtgtcttcctgaatttcagccagcggtgtggtgcccgctaacacatcgcctgcggttggcgtttccagacctgccagcaggcgcagcagggtacttttgccaccaccgctgcggcccaccaccgccacaaactgacctgccggaatatgtaaatccagttggttcaggacgatattttccgcgtaatgtttgcttactgcattgagcaacaatggcgtgccctggttcagacgagcagtattcataccgtggcctccttcaaatgataagccgggttccagcgcaaccagaggcgctctaacagctgcgcgctgacgtcagccagtttgccgagcagggcgtaaagaataatagcgactaccaccacgtccgtttgcaaaaactcccgcgcattcatcgccagataaccaatgcctgaattggcagaaatggtttcggcaacaatcagcgtcagccacatcaggcccaacgcaaaacgcacgccgaccataattgagggcagggcaccaggcaggatcacatggataaacagcggtatgccggataatccatagctacgcgccatctccaccaacccgcgatcgatattacggatgccatgccaggtgttgatataaatggggaatagcgtaccgagcgccaccagaaagatttttgcggattcatcaatgccaaaccacaaaatcaccagcgggatcagcgccagatgcggcacgttgcgcaacatctgaattgaggtatccagcagccgttctccccagcgagatagcccgctaatcagtcccaaaatcaaccccagcgatccgccaattgaaaagccaatcagcgcccgccaggagctgatcgccagatgctgccacagttcgccgctggcggagagcgtccagaacgccgtcaccactccttccggtgaaggcaaaatacgcgtcgacagccagccaaccgaggaggccagttgccacaccgccacgatgcccaccggtaaaaaccagggggcaacgcgcaataaccacttcttcactggcgttgccattatttcttccttagctttgcgcgactttacgggggataaaatcattcgccaccgcttcgccttgcggattcagcggctgcggctggggaatttccgggatggcgacatccagaagcgggaacagcaactcgccaacccgatacgcttcttccagatgcggatagcccgaaagcacaaaactgtcgatgccaagcgcggcatattcgttgattcgcgcagcgaccgtaggaccatcgcccaccagcgccgtcccggcaccgccgcgcactaagccaacgcccgcccataaattggggctgatctccagattgtcgcgcttgccgttatgtaacgccgccattcgctgttgccctacggaatccgtccgggcgaatgcggcctgtgctttggcgatagtttcatcatcaagatgcgagattaaccgctcggcggcctgccacgcttcgtcgttagtttcacgaacaatcacatgcagacgaataccgaaacgaattttgcgtccatgcgcggcagctttcgcccgcacttgttcgattttctctttaaccagttccggcggttcgccccaggtgaggtagagatcaacctgttctgccgccagctcctgggcgacatctgacgatccgccaaagtaaagtggcggatacggctgttgaatcgccgggaagagcagttttgctccgcgcacatgaatatgtttaccgttgaaatcgacggtttctctctgcaataaacgccgccagacctgggtaaattccgccgaggcttcgtagcgctcgctatgatcaaggaacactccgtcgcctgccagctcttgtggatcgctgcctgtgaccaggttaaacaacgcacgtccatttgagagacggtcaagcgtggcggcctggcgggcggcaacggtaggtgaggttacgctgggacgcagggcgacaagaaacttcagccgctgcgtcaccgggatcatcgatgcggcaaccagccacgcatcttcgcaggagcgccccgttggaattagcacaccggtatagccaagacgatccgccgcttgcgcaatttgttgcagataaccgtgatcaaccgggcgtgaaccttcttccgttcccagataatgcccgtcaccgtgggtcggtaaaaaccagaacatattcagactcataattgttttccttccagttgagtgggctgccagatgcgctggcgaatatcgacttttttcggcaccagacgattttcataaaacagatctgccgtttgctgctgtaaggcggcaacctcggcgttaaccggtttgatggtggtaggagggcgatgatctaagtaagaggcaatcaccggtgccggtaagcccatcgtttttgccagtaaagcgatgctttgctcgcgctggctgcgggttaacgcatcggcctcactaaaggttgccagtacgccctgaataaaagcgccgtttttttctgcatagggacgagctgccagataaaacgatccagtttgattgagatcggtgccgtctttcagcacccgcacgccgccctgtaataatgcagcagagtagtagggatcccagatagcccaggcgtcaacgttaccttgctggaacgcggcgcgggcatcagcgggcgtcaggtaagtgggttggatatcggtaaacttaagtccggcctgacgcagtgcacgcagtaaaaggttgtgtgaactggaacctttctgaaaggcaactttgtgacctttaagatcggctacggttttgatcgggctgttttctgccaccagaatcacttcggctttgggcttcggtggctcgacgcccacgtacaccaaatcagccccggcagcctgggcaaagattggcggaatatccccggtactgccgagatcaatactgccaacgtttaacgcttccaacatttgcggacccgcggggaactccacccaggagatttttgattccggatagcgtttttccagtaactggtggctttttgccagcaccataccaatactgcctttctgatagcctatacgtaacgcttcaggcgaggattctgcagcaaccgcaaaagtagagacgctaagcaatcccgccagcgccagtttaatgatgttacgcatgggcattacctcgcagagacagaaggtcaggaacctgaacatcgcggcggtgcaatgcctgccagaaagtttctagcgcggtatcaagacgggtttgcagatttggcgtgaactggggtctgtgatggtaatcaattacttgtgagtcatcggcaaacacgccgtgcaggatctcctgagctttcagtgcgcttaaaactggtttaagggcataatcgaccgccagcagatgggccacggtaccgcccgtcgccagcggtagcaccactttgccttgcaaagcgcgttctggcagcaggtcgagcagggttttcaacgcaccggaataggcggctttatacacaggcgtggcgacaatcagcccatcggcctgttgcagctgttcggtgaaggtcttgagtgccggactatcgaaacgagcataaagtagatcttccggggcgaagttttgcagattccagtgataaacctctacatccaggccatttagtttttcccgcgcatattccagcaaggagctggagcgagaaggaaagcgaggactacccgccagggtgatgacacgcatactctctccttataaccaattgttctttttttgttaacattgataacaattcggtcagtctgtcggagagacaagaaaattccaaatataaattttgtgtatctttttctgaaaataaactaaagaaagggctttatatatcacgcatatttatttattggatagtcattagatgttgaatcaatgaattactcgttcagttaatatttaaatattcatgaaatctataaattaaagatttgtcacttattggatttagtatgcttgatttaaatggcggacaattattgttattattaagtctaatgtcatttaaaggcattatcatatttacgaagagatcaggatgataacgatgaaaaaaagtgtattgacggcgtttataactgtggtatgtgcaacgtccagcgttatggctgctgatgataatgctatcacggatggctcagtaacatttaatggtaaagttattgctccagcttgtaccctggtagctgcgacgaaagattccgtggtgactttgccagatgttagtgccacgaagttgcaaaccaatggtcaggtttctggcgtgcaaattgatgtgccaattgaattaaaagattgtgatactaccgtaacaaaaaatgcaacgttcacctttaatggcactgcggatactactcagattacagcgtttgctaaccaggcctcatctgatgctgctacaaacgtggccctgcaaatgtatatgaatgatggtacaacggccatcacgccagacacagaaaccgggaacattttgttgcaggatggagatcagacgttgacttttaaagttgattatatcgctacggggaaagcgacttcaggtaatgtgaatgcggtaacaaatttccatattaactattattaatagaactcattaattgttttattaattagtacccctccagtgttctggaggggatattcatattttttaagagtgactatttatgaaaacttgcataacaaagggaattgtgaccgtaagtttaacggcaatattactcagctgctcatccgcatgggcggcaggtaaaggcgggattggacttgcagcaacacgtcttgtttattcagaaggtgaagagcaaatttcactgggtgtacgtaacaccagtccggatgttccttatcttattcagtcatgggtgatgaccccagataataaaaaatcagcagactttattattacaccaccgctatttgtgctgaatccggcaaatgagaatctgttacgcattatgtacattggagcgccgttggcgaaagacagagaaacccttttcttcactagcgtacgggcagtcccttcaacaacgaagcggaaagagggaaataccctgaagattgccacacaaagcgtcatcaaacttttctggcgaccaaaaggtttagcgtatcccttaggcgaggctccggcgaaactgcgttgcacttcgtcagctgacatggttacggtcagtaacccaacaccttatttcattaccctgacagacctgaaaataggtggaaaagtagttaaaaatcaaatgatttccccctttgataaataccaattttctctgccaaagggggccaaaaatagcagcgtaacgtatcgaaccatcaatgactacggggcggaaacgccgcaactcaactgtaaatcgtaagccgtcttcagttaagagagcgagatgtatagaactcatcgacaacacagcctgttaagctctggtggagtgccatcgtttattggtgggctggtggtgtttgtgtcggcagcgttcaatgcacaagctgaaacctggttcgatcctgcttttttcaaagatgatccctcaatggtggccgatttgtctcgtttcgaaaaaggacaaaaaataacgccaggggtttatcgtgtcgatattgttctgaatcagacaattgtagatacgcgcaacgtcaattttgttgagataacgccagagaaggggattgccgcctgtttgacgactgaaagcctggatgcaatgggtgttaatactgatgcgtttccggcttttaaacaactggacaaacaagcgtgtgtgccattggcggagattattccggatgccagcgtaacgtttaatgtgaataaactccgtctggaaatttcagtaccgcaaatcgccatcaaaagtaatgcccgtggttatgtcccccctgaacgttgggatgaagggatcaacgcgctattactgggatattcgtttagcggggctaacagtattcatagcagcgcagacagtgattctggcgacagctattttctgaatttaaacagtggcgttaatttaggcccatggagattgcgcaacaattcaacatggagtcgtagtagtggccaaaccgcagaatggaagaatctcagcagctatttgcaacgggcggttattcctctgaaaggcgaactgaccgtaggtgatgattatactgcaggcgattttttcgatagtgtcagctttcgtggtgtgcagctggcgtcagatgacaacatgctgccagacagcctgaaagggtttgcgcctgtggtgcgtggtatcgccaaaagcaatgcccagataacgattaagcaaaatggttacaccatttaccaaacttatgtatcgcctggtgcttttgaaattagtgatctctattccacgtcgtcgagcggtgatttgttagttgaaatcaaagaagcggacggcagcgtcaatagctacagcgtaccgttctccagtgtgccattactccagcgtcaggggcgaatcaaatacgcggtgacactggcgaaatacagaaccaatagtaatgaacagcaggagagcaaatttgcccaggccacgttgcagtggggcggaccgtggggaacgacctggtatggtggtggacaatatgctgaatattaccgtgccgccatgtttggtctgggatttaacctcggcgatttcggagcaatttcgttcgatgcgacccaggcgaagagtacgctagcagatcaaagcgaacataaaggtcagtcatatcgttttctgtatgccaaaacgctcaaccacttgggcactaactttcaattgatgggctatcgctattcgacgtcgggtttctacaccctttccgacaccatgtataaacatatggatggctacgaatttaatgacggtgatgatgaagatacgccgatgtggtcgcgttattacaatttgttttacaccaaacgtggcaaactgcaggtcaatatctcccagcaattaggcgagtacggttcgttttatttaagtggtagccagcaaacttactggcatacggatcaacaggatcggctattacagtttggctacaacacgcaaattaaagatctttcgctggggatttcctggaactacagtaagtcccgtggtcaacctgatgctgatcaggtgtttgctctaaatttttccctgccgctcaatctgttgctccccagaagtaatgatagctataccaggaaaaaaaattacgcctggatgacctctaacaccagtatcgataacgaagggcacactacacaaaacctgggtttaacggagacattactcgatgacggtaacctgagctacagcgtgcaacagggatataacagcgaggggaaaacggctaatggtagcgccagcatggattacaaaggggcgtttgcggatgcccgagtgggctacaactacagcgataacggcagtcaacaacaactgaactacgctctttcaggcagtttagttgcccattcacagggcattaccctggggcaatcgctgggggaaactaacgttctgattgcagcaccaggcgcagagaatactcgtgtggcgaacagcaccgggctgaaaactgactggcgcggatataccgttgttccttatgccacttcttatcgggaaaatcgaatcgcacttgatgcggcgtcgttaaaacgtaacgtggatcttgaaaatgcagtagtcaacgtggttcccaccaaaggggcgttggttctggcggagttcaatgcccatgcgggtgcaagggtattaatgaaaacatcaaagcagggtataccgctgcgttttggcgcgatagcgacgctggacggcgtacaggctaatagcggcataattgatgatgatggctcgctctatatggcgggtttaccggcgaagggaacaataagcgtgcgctggggcgaagctcccgatcaaatttgtcatatcaattacgagcttaccgaacaacaaattaactctgcgattacgcgaatggatgccatatgcagataatctttggagaaaaatgcgtgtcattactacgactattttttgccgccgtcttaatgttatggtgcgctcaaaccgctgcttatagcgggcagtgtcatactactcaggggaatccgtatattggcgtcaattttggcgttaaaaccctggaggaagaagcaaatacggcaggggtagttaaagacaaattttatcagtggaacgaatcgaatgattattatgtttcctgtgattgcgataaagacaatgtcagaagtggccgatgggcattcgccgcggattcaccgttagtctatttaggcgacaactggtacaaaattaatgactatcttgccgccaaagttttattgcaggttaaaggcagttctcctactgcggttcctttcgaaaacgtgggcacagggggggatacccgatggcatatttgcgaccctggcggtcaacgtttaggtgggcagggggcaagcggtaatagcggtagcttttccctgaaaatattgcagccgttcgttggctcggtcgtcattcctcctatggcgctggcgcgattatatgaatgctacaacatacccgcaggtgattcctgcacgactacaggtacaccggttttagtgtattacctgtctggtacgatcaattcacttggctcatgttccgtcaatgccggagagacaattgaagttgatttaggtgatgtcttcgctgccaatttccgtgttgtagggcataaacctcttggggccagaacggcagaacttgcaattccagtcaggtgtaacacgggaaacgcgggattagttaatgtcaacctgagtctgacggcaaccacagaccccagctatccccaggcgattaagacgtcacgtcctggcgtgggcgtggtggtgaccgatagccagaacaacattatttcccctgctggtggaacattaccgctctctattcctgatgatgcagacagtatcgcgcgaatgaatgtctatccagtcagcacgacaggtgtaccaccagaaaccgggcgatttgaagccacggcaacggtgagaataaattttgattaacgcgtgaacgtatgaagaaaaaaacgatatttcagtgcgttatcttgttctttagcattcttaacatccatgtcgggatggctgggcctgaacaagttagtatgcatatttatgggaatgtggtcgatcagggctgtgatgtcgccaccaaaagtgcattacaaaatattcatattggtgattttaatatcagtgattttcaggccgcgaataccgtaagcactgctgctgatttgaatatcgatatcaccggttgtgccgctggtattactggcgcggacgtcctttttagcggcgaggctgacacccttgcgccgacactgctcaaactaactgacacaggcggaagcggtggtatggcaacggggattgccgtgcaaattcttgatgcgcaaagtcagcaagaaatcccgctcaatcaggtccagcctcttacgcccttaaaagccggggataacacactcaaatatcaacttcgttataagtccacaaaggcgggagcaacgggcggtaatgcgacggcggttctctattttgatctggtttaccagtgaaggagtgatgttgaaacggataatctggattctgttcttattgggattaacgtggggctgtgagctatttgcccatgatggcacggtcaacattagcggatcgtttcgccgtaatacatgcgtgctggcacaggatagcaagcaaatcaatgtgcagttaggcgatgtctcgctgacacgtttttctcatgggaattatggcccggagaaatctttcatcattaatttgcaggattgcggaacagatgtcagcacggttgacgtcaccttttcaggaacccccgacggagtgcagagcgaaatgttgtccattgaaagtggtacggatgcagccagcgggctggcaattgcgattctggatgatgcgaagatattgattccgcttaaccaggcgagtaaagactacagcctacatagcggtaaggtgccattaactttttatgcgcaattgcgacctgtcaatagcgatgtgcagtcgggtaaagtgaatgccagcgcgacatttgtacttcattatgactaatacgtggaacagattggcgctcttgattttcgccgttttatcgctgctggtggcgggtgaattgcaggcaggagtggtggtcggcggaacgcgatttatctttccggcagacagagaatcgatatctattttactgactaataccagtcaggaatcctggcttattaacagtaaaatcaaccgcccaacgcgttgggccgggggggaagcgtcgacagtgccagcaccattactggccgctccgccacttattctcctgaagcccggtacgacaggcacgttgcgcttgctgagaacggaaagcgacatcttgcctgtggatcgcgaaacgctatttgagttaagcattgccagcgtgccatccggcaaagttgaaaatcagagcgtaaaagtggcgatgcgctcggtatttaaactgttctggcgacccgaaggtttgccgggcgacccgctggaagcttatcaacaattacgctggacacggaattcgcagggtgtacaactcactaacccaacgccttattacattaacctgattcaggtgagtgtaaatggtaaagcgttaagtaatgtgggagttgtgccgcctaaaagccagcgtcagacaagctggtgtcaggcaatcgcaccgtgtcatgtcgcctggcgggcgataaatgattacggcgggttgagtgcaaagaaggagcaaaatctgccctgaaacaggttcggaaaacgtttgcgttttttttgccgcaggtcaattcccttttggtccgaactcgcacataatacgcccccggtttgcacaccgggaatccaggagagttcatgtactaccccttcgttcgtaaagcccttttccagctcgatccagagcgcgctcatgagtttacttttcagcaattacgccgtattacaggaacgccgtttgaagcactggtgcggcagaaagtgcctgcgaaacctgttaactgcatgggcctgacgtttaaaaatccgcttggtctggcagccggtcttgataaagacggggagtgcattgacgcgttaggcgcgatgggatttggatcgatcgagatcggtaccgtcacgccacgtccacagccaggtaatgacaagccgcgtctctttcgtctggtagatgccgaaggtttgatcaaccgtatgggctttaataatcttggcgttgataacctcgtagagaacgtaaaaaaggcccattatgacggcgtcctgggtattaacatcggcaaaaataaagatacgccagtggagcagggcaaagatgactatctgatttgtatggaaaaaatctatgcctatgcgggatatatcgccatcaatatttcatcgccgaataccccaggattacgcacgctgcaatatggtgaagcgctggatgatctcttaaccgcgattaaaaataagcaaaatgatttgcaagcgatgcaccataaatatgtgccgatcgcagtgaagatcgcgccggatctttctgaagaagaattgatccaggttgccgatagtttagttcgccataatattgatggcgttattgcaaccaataccacactcgatcgttctcttgttcagggaatgaaaaattgcgatcaaaccggtggcttaagtggtcgtccgcttcagttaaaaagcaccgaaattattcgccgcttgtcactggaattaaacggtcgcttaccgatcatcggtgttggcggcatcgactcggttatcgctgcgcgtgaaaagattgctgcgggtgcctcactggtgcaaatttattctggttttatttttaaaggtccgccgctgattaaagaaatcgttacccatatctaattatttcttcgaattcctctttataagataatcagggctttattttcagccctggttgttttatattcatcgctgttgcttatttagacattttgtacttttattgttgaggttattaagcgaagcgacaatggattgtgttgctgcggttttatagggtaggggagaggcagatgcgaattaaaccagacgataactggcgttggtattacgatgaagagcacgatcgaatgatgctcgatttagccaatggtatgctatttcgctcacgttttgcgcgcaagatgttgactccagatgccttttctcccgcaggcttttgcgttgacgacgccgcgctctatttctcttttgaagaaaagtgccgcgattttaatttatctaaagaacaaaaagccgaactggtgctgaatgcactggtagcaattcgctatctcaaaccgcaaatgccgaaaagctggcattttgtttcccatggtgaaatgtgggtgcccatgccgggcgatgcggcctgcgtttggttgagcgatactcacgagcaggtcaatttgctggtcgttgaatctggcgaaaatgccgcactatgcctgctggcacaaccctgcgttgttattgcgggtcgcgcgatgcagttgggcgacgccattaaaatcatgaacgacaggctgaaaccgcaggttaatgttgacagcttcagcctcgaacaggcagtctaacgcgccaacttaagtgcagtcttcggtacacagctacagcaaagaatggtgccatcatcgcccattgctgattttttcagcggcgtgacttcgccttctaaaagctgaacacggcaacttccacaaatgcccgcgcggcaagaataagggatacgaattccctgattttctaattgctccagcaacacctgttggttatttccacgaaatgcctgtccctgccagtcaatatctacatttgcgtccggttgttgcgtgatgttggcggtatcatcagcggcagctgcgccgtaaatttttgccggagccgttgccagaatttccacctcatcgccaacgcgaatcacgccgctattacgggcaattaaattctgaccaaaatcgacatcgccgttatcctgggcagtgcggaaagattgcaatgtttttaatggttcgcctgccggatgtttttgccctttttctgggctgacggtggtgaaaatacagcggctacaaggtttaaccacatcaaacaccacatcaccaatgcgaatcactttccagcgatcttcttcccaggctgacgcgccggaaaccaccagattggggcggaattgctccatttttacactggccggacaacgttgttggagatcacgtaacgaggcttcgttagcaagaaggtaaggatagccatcagcaaatgacagaggtacagtgttgtggcgtttcacgcgccgggtcatttgtggccccacccagcgtaattgcacttcgcgggagaaaaatccacttagccatttgttgatcgcgtctggcgcaattcgcgcggtaaaatgtgtgccccaaacttcggttggtgcgtcttgtgtggcgaaatcagcaaaacgaacatatgcgctactgccatctggtgcggtgagatgcaagccatcatgcacaggtgaaggagtaaaccgtaccatctggggaaactggcgagcggtaataaacgtaccgtcaggttccgtgatcataaagatgcgatcgaaggccagaccactgacatctgccagagcatgtgtaagaccaatgccgcgcatcgatttaacaggatgaataaaaagccggattaatgtcgccacggtgcggtcctcaaatgaaaataagccctcaactttatgacatgacgcgcttattagctataatgcgcaacaattttcttagcgcctgtcccattaggctattttatttgtcagtttggccctgggttatgctcgaaatcctcacgtacttgtgtacgctccggtttctccgcgctgtccatgtccagactgactgcaacaattacgcctactgcggtaggctcttagagtaaaagtgacgatatgaattctctgtttgccagtacggcccgtgggctggaagagctgttaaaaactgaactggaaaacctgggggccgttgaatgccaggtggttcagggtggggtccatttcaagggcgacacacggcttgtttaccagagcctgatgtggagccgcctggcctcgcgtattatgttgccgctgggcgagtgtaaggtttacagcgatttagacctctatctcggtgttcaggcgatcaactggacagagatgtttaatcctggcgcgaccttcgctgtccacttcagtggtttgaatgacaccatccgcaacagtcagtacggcgcgatgaaagtgaaagacgcgatcgtcgatgctttcacgcggaaaaatctgccgcgtccaaatgttgatcgcgatgcgccggatatccgcgttaacgtctggctgcataaagaaaccgccagtatcgctcttgatctgagtggtgatggtttacatctgcgtggctatcgcgatcgtgctggtattgcgccgatcaaagaaaccctggcagccgctattgtgatgcgatccggctggcagccaggaacaccgctgctcgatccgatgtgtggttccggtacgttgctgattgaagcagcgatgctggcgaccgatcgcgcaccaggcttgcaccgtgggcgttggggctttagcggctgggcgcagcatgatgaagctatctggcaggaagtgaaagcggaagcgcaaactcgcgcccgtaaaggcctggctgagtatagctctcatttttacggttcggacagcgacgcacgggtgattcaacgtgcacgcactaacgcccgtcttgcggggattggtgaactgatcacctttgaggtgaaagatgtcgcgcaactgaccaatccgctgccgaaagggccgtacggcacagtgttgagcaacccgccatacggggaacgtctggacagcgaaccggcgctgattgcgctgcatagcctgctgggtcggatcatgaaaaaccagtttggtggctggaatctctctttgtttagtgcctcgccggatctgctaagctgcttgcagctgcgtgcagacaaacagtacaaggcgaaaaacggcccgctggactgcgtacagaaaaattaccacgttgccgaaagcactccagacagcaaaccggcgatggtagcggaagactacaccaaccgcctgcgtaagaacctcaaaaaattcgagaagtgggctcgccaggaagggattgaatgttaccgcctgtatgacgccgatctgccagaatataacgttgccgttgaccgttatgccgactgggtggtggtgcaggagtatgcgccgccaaaaactattgatgctcacaaagcgcgtcagcgtctgttcgatattatcgctgcaaccatttcggtactggggattgcgccaaacaaactggtgctgaaaacccgtgaacgccagaagggcaaaaaccaataccagaaactgggcgagaagggcgagtttcttgaagttaccgaatataacgctcacttgtgggtgaacctgacggattatctcgatactggtctgttcctcgatcaccgcatcgcccgtcgtatgctcggtcagatgagcaaaggcaaagatttcctcaacctgttctcttataccggcagcgccaccgtgcatgcgggattaggcggtgcacgcagcaccaccaccgtggatatgtcgcgtacttatctggaatgggcagaacgcaacctgcgtctgaatggcctgaccgggcgtgcgcatcgcctgattcaggccgattgcctggcgtggctgcgtgaggcaaatgaacagttcgatctgatctttatcgatccgccaaccttctctaactcaaaacgaatggaagatgcgtttgatgttcagcgcgatcatctggcgctgatgaaagatttgaaacgtctgctgcgtgcaggtgggacgatcatgttctcgaacaacaaacgtggcttccgtatggatctcgacggcctggcaaaactgggactgaaagcacaagaaattacgcaaaaaacgctctcccaggatttcgcccgtaaccgccagatccacaactgctggctgattaccgcagcctgaaaggaatagtaatgtcattaatcagtatgcatggcgcatggctgtcgttcagcgacgcgccgcttctcgataacgcagaactgcatatcgaagataacgaacgtgtttgtctggtgggccgcaacggcgcaggcaaatcgacgttaatgaaaatcctcaaccgtgaacaagggctggatgacggtcgcattatttacgagcaagatttgattgtagcgcgtctgcaacaggatccgccgcgtaacgttgagggtagcgtttatgatttcgttgccgaaggcattgaagaacaagcggaatatctgaaacgctatcacgatatttcgcgcctggtgatgaacgacccgagcgagaaaaatctcaacgaactggcgaaggttcaggaacagctggatcaccacaacctgtggcagctggaaaaccgcatcaacgaagtgctggcgcaactggggttagatcctaacgttgcgctgtcgtcgctttccggcggctggttgcgtaaagcggcattaggacgcgcgctggtgagtaatccgcgcgtgctgttgcttgatgaaccgacaaaccacctggatattgaaaccatcgactggctggaagggtttttgaaaactttcaacgggacgattattttcatctcccacgaccgttcgtttatccgcaatatggcgacgcgcattgttgatctcgatcgcggcaagctggtgacctatccagggaattacgaccagtacctgctggaaaaagaagaagccctgcgcgtggaagaattacaaaatgccgagttcgatcgcaaactggcgcaggaagaggtgtggatccgccaggggatcaaagcacgccgtacccgtaatgaaggccgcgtacgcgccctgaaagcgatgcgtcgcgaacgtggtgaacgtcgcgaagtgatgggtaccgcaaagatgcaggtggaagaggccagccgctccggtaaaatcgttttcgaaatggaagacgtttgctaccaggttaacggtaagcaactggtgaaagatttttctgcccaggttctacgtggcgacaaaattgccctgattggtccgaatgggtgcggcaaaaccacgctgctaaaactgatgctcggtcagcttcaagcggacagcgggcgtattcacgttggcaccaaactggaagtggcttatttcgatcagcaccgcgcggaactggatcccgataaaacggtgatggataaccttgccgaaggtaagcaagaggtgatggttaacggcaagccacgccacgtattgggctatttgcaggactttctgttccatccgaaacgggcgatgacgccggtacgtgcgctttctggcggtgagcggaaccgcttgctgctggcgcgtttgttcctcaaaccaagcaacttattgattcttgacgaaccgaccaacgatcttgatgtcgaaacgctggaactgctggaagaactgatcgacagctatcagggcacggtattgctggttagccacgatcgtcagtttgtcgataacaccgttacagaatgttggatcttcgaaggcggcggtaaaattggtcgttatgtcggcggttatcatgatgcccgtggtcagcaagagcagtatgtggcgctcaaacagcctgcggtgaaaaaaaccgaagaagccgccgcggcaaaagcagaaactgtaaaacgcagcagtagcaaactaagctataaattgcagcgcgaactggagcagctaccgcaattgctcgaagatctggaggcgaagctggaagccctacagacgcaagtggcggatgcttccttcttcagtcagccgcatgagcagacgcaaaaagtgcttgctgatatggctgctgcagagcaggagctggagcaagcctttgaacgctgggagtatcttgaagcgttaaaaaatggtggctgatcgcaaaatagtcgatttaaacagagacagctgacaacggtaaaattgcctgatgaactgggtttatcaggcatgaaaaccaacactttgttagtcatctgtaaaatagcgcatcattaaggagtaccaatgtgcgaacatcatcatgccgcgaagcacatcctgtgctcgcagtgtgacatgctggtggcgttaccgcgccttgagcatggtcagaaagcggcatgtccccggtgtggcacaacgttaaccgtggcgtgggatgcccctcggcagcgtcccaccgcctatgcgttggctgcactgttcatgctgttgctgtccaacttgtttccttttgtgaatatgaacgttgcaggagttaccagtgaaattacattactggaaattcccggcgtgcttttttctgaggactacgccagcctcggcacctttttcctgttgtttgtgcaactggttcccgcgttttgtctgataaccattctgttactggtgaatcgcgcggaattaccggtccgtttaaaagagcaactggcacgggtgctttttcaactcaaaacctggggaatggcggagattttcctcgcgggtgtgctggtcagtttcgttaaactgatggcttacggcagcattggggtaggcagcagctttctcccctggtgtttattttgtgtcctgcaactgcgcgcttttcagtgcgttgatcgtcgctggttatgggacgacatcgccccgatgccagaactgcgccagccgctaaaaccaggcgtcacggggatacgtcaggggctgcgttcgtgctcctgttgtacggcaatccttcctgctgatgaacccgtgtgcccgcgttgtagtaccaaagggtacgttcggcgtagaaacagcctgcagtggacactcgcgctgcttgtaacgtccatcatgctgtatcttccggctaatattttgcccatcatggtgacggatttattaggctcgaagatgccgtcgacgattctcgctggggtcattctgttatggagcgaaggctcttatcccgtcgctgcggtgatctttctggccagtattatggtgccaacgttaaagatgatcgccatcgcgtggctgtgttgggatgccaaagggcatggcaagcgcgacagtgaaagaatgcatttgatttatgaagttgttgagtttgtaggccgctggtcgatgattgacgttttcgttatcgcggtgctctcggcgctggtgcgtatgggaggtttaatgagtatttatccggcaatgggtgcattaatgtttgctttagtcgtcataatgacaatgttttctgctatgacgtttgacccgcgtttgtcgtgggatcgtcaacctgaatcagagcatgaggagtcctgacagtatggaatctaataatggggaagccaaaatccagaaagtgaagaactggtctcccgtgtggatatttcctatcgtcacggcgctcattggggcctgggttcttttttatcattacagccatcagggaccggaagtgaccctgatcaccgcgaatgcggaaggaattgaaggtggcaaaaccaccattaaaagccgtagcgttgacgtcggcgtggttgaaagcgccacactggctgatgatttgacgcacgttgaaatcaaagcgcggctgaattccggtatggaaaaattgctgcataaagacaccgtcttttgggtggtgaaaccgcagattggtcgcgaagggattagcggcctgggaacgctgctgtctggagtttatatcgaactgcagccaggcgcgaaaggcagcaaaatggataaatacgatttgctggactcgccaccgttggccccgcctgatgcgaaaggtatccgtgtgattctcgatagcaaaaaagccgggcagctctcgccaggagatccggtgctgttccgtggctatcgggtaggttcggttgaaaccagcaccttcgatacacaaaaacgcaatatcagctatcaactgttcatcaatgcaccttatgaccgactggtgaccaacaatgttcgcttctggaaagatagtggcattgcggttgatctgacgtcagcagggatgcgtgtggagatgggctcattgacaacgctgctgagtggcggtgtcagctttgatgtgccggaaggtctggatttagggcagccagtggcaccgaaaacagctttcgttttgtatgatgatcagaagagcattcaggattcgttgtacaccgatcacattgattatctgatgttctttaaagattcggtacgcggtctgcaaccgggagctccggtagagttccggggtattcgcctgggtaccgtaagcaaagtgccattctttgcgccgaatatgcgtcagacatttaacgatgattaccgtattccggtactgattcgtatcgagccagagcggctgaaaatgcagcttggcgaaaatgcggatgttgttgagcaccttggcgaattgttgaaacgtggtttacgcggatcgctgaaaaccggaaacctggtcactggtgcactgtatgttgatctcgatttctatccaaatacgcctgcaataaccggtattcgtgaatttaatggttatcagattatcccgaccgttagcggcggcctggcgcaaatccagcaacgactgatggaagcgttggataagatcaacaaactgccattgaatccgatgattgaacaggcaaccagtacgctttctgaaagtcagcgcacaatgaaaaacctgcaaacgacgctggatagcatgaacaagatcctcgctagccagtcgatgcagcagttgccgacggatatgcagtcaacgttgcgtgaattgaatcgcagcatgcagggcttccagcctggctccgcagcctacaacaagatggtggcggatatgcagcgccttgatcaggtgttgcgagaactgcaaccggtgctgaaaacgctcaatgagaagagtaacgcgctggtatttgaagcgaaggacaaaaaagatccagagccgaagagggcgaaacaatgaaaaagtggctagtgacgattgcagcactgtggctggccggatgcagctccggcgaaattaataaaaactattaccagttacctgtggtgcagagcggtacacaaagtaccgccagccagggcaatcgtctgttatgggtagagcaggtcactgttcctgactatctggcggggaatggtgtggtttatcaaaccagtgatgtgaagtatgtgattgccaacaacaacttgtgggccagcccgttggatcaacagttgcgcaacaccctggttgccaacctgagtacgcaactgcccggctgggtggttgcctcccagcctctgggaagcgcccaggacacgctcaatgttaccgtaacggagtttaacggtcgctatgatggcaaggtcattgtcagtggtgagtggctgttgaaccaccagggacaactgatcaaacgtccgttccgtctggaaggagtgcaaactcaggatggttacgatgagatggttaaagtgctggccggtgtctggagtcaggaagccgcttctattgcacaagagataaagcgtctaccttaattataaagatttgtaaatataaccgtctccggtatgttgcctgaggcggtttttttgtctctaacgtgcggaaaaatttgttcctcttcacattttttgtacaaccgacatgcccgtgtagctcacaaatatgacagtggcgtgaattttgcgcattgacggcagttatgattcgcggtattgcttaactgtgattgcacatttagtaatcactgttttcttttccaccagaaaccagtatgagggaaacgaggcatgaagagacaaaaacgagatcgcctggaacgggcacatcaacgtggttatcaggccggcatcgccggacgctcaaaagaaatgtgtccctatcagacgctgaatcaaaggtcacaatggctgggaggctggcgagaagccatggcggacagggtagtaatggcctgattctgtctctttaaaaagaaacctccgcattgcggaggtttcgccttttgatactctgtctgattataatcagaaggcagacgtatcctggaacagaccgactttcaggtcgctggcggtatagatcagacgaccatcaaccagcacttcgccatccgccaggcccataatcagacgacggttaacaatgcgtttaaagtgaatacggtaggtcacttttttcgctgtcggcagtacctgaccagtgaatttcacttcgccaacgcccagcgcgcggcctttaccttcgccgcccagccagccgaggtagaaccctaccagctgccacattgcgtccaggcccaggcatcccggcataaccggatcgccaataaagtggcatccgaagaaccacagatccggattgatatccagttctgcttcaacataccctttgtcgaagttaccacccgtttcggtcattttgaccacacggtccatcatcagcatgttcggtgctggcaattgcgggcctttagcgccaaacagttcaccgcgaccagaggcaagaaggtcttcttttgtataggattcgcgtttatctaccatgttctctgtaagccttattttattgaagcacgcaggatagctaacacgtgtacgctgaacaagtccgatcagttcggaataaaccagttcagccaacgtaatggccatggaaaacggtgacgtccttcctgttgcgatgcttgcgcgatacgttcctggatggtttgcatcagcgtcgtttggccttcgccatcccacaccagatttaataataacggcagtgcgtcagtcacatcgtctactgcccagatggtgaatttgccttcttctaccgctttcaccagttcactgtgaagacttaaatggcgaacgttagctgtggggataatgacaccttgtttcccggttaactcacgttgctggcaaatagcaaagaagccttcgattttctcatttaaaccaccgaccggctgggcgcgaccgaactgatcgactgaacctgtgatagcgatactctgattcaccggcacatcggcgagggcgcttatcagggcgcagagttcagccatcgaggcactatctccatcaacttcactgtatgactgctcaaatgtcagcgatgctgagaaggggatctgttgctcaagctgtagttccgacatcaggaacgcttgcatgatcatcatccctttcgcatggatattgccgccaagctccgctttgcgttcgatgtcggtgaattcaccatcgccaatatgcacaacgcagctaatgcgagaaggttcgccaaaagcgcgtggatgacccggaaattcaatgaccgaaagggcgttaatttgcccgatgcgttcgccttcggtttcaatcaggatttgctcctgaaggatctcatcctgcatacgttcagcgaggaaaccttcgcgccattcacgctgctgcagcattaagtttagctgctcgccggagaaggtgtcgccatcacacagggaggcgacctctttacactggcggaggatccactgcgggctaagcggaagtgtttcttgttcaccggtgtagcgtgctgcttcgcggataagtatcggccaggcatccgctcccggtgcaggtaagtgattatgtctggcggtaaatgtcacccagcgacaccactgggttactgactccgcatcgacaatctgcagagtatcttcaaattcgctataaatagcctgctctgaaagctctggctccatctcctggaaatcagccaatgattcgcgttcgcctaccagaatgactttcagcttcaatggcatcgaaggcacagagacggggagagggcgcgactcatcaaacgcaacccagtcaaaacgctcgcggttaacgatatttttcagccgcatccacagcagaggttgcgccagcagtgtacgcaaagagataatgagaataccgccatttgcctgatgcaccagaccaggctgcagggtaatgtcgccattaaactggcgcaggcagccaaagagttgctccgcttctacccagtcggcagcgacaacttgcgttaaagtcgcaaaattatcatctgcactcactgcgtgacgtaagcggatggagtggccggaaacctcatagtgaccgcccaccagttggcctgcatcgctttgtagcgtacgcgcggcattggcaataagattcagatactcagactcttccggggccttcgccagcataaaagaggaggatgctcgcgtatgcagcaactgctccagcgcaaattgcagccgcggttgagtatcactgaataaaggatcgttttcgtcaatcaaatgtggctgagcaaatatttcctgatagctatcggtatcaggaaccaggtcacgccatgcaagtttcgtaatggtcaaagttgatgttttttagtctgttgtcaaagccgcgattataccgtaaccggcactacagcacacgtagaaagcaccgacaatactcctggcatgggcgttaaagctcacaggatggagattcttttcttcactggcctaaaaagctgatattctgtaaagagttacacggtaacattgagatcgctatgaaatatcaacaacttgaaaatcttgaaagcggttggaaatggaagtatctggttaagaagcatcgcgaaggggagttaatcacccgttacatagaagccagtgccgcccaggaagccgtcgatgtgttgctctcgctggaaaatgaacccgtgctggtaaatggctggattgacaagcatatgaatccggaactggtcaatcgcatgaagcaaaccattcgggcaagacgaaagcgccattttaatgcggaacaccagcatacgcgcaaaaaatcgatcgatctggaatttattgtctggcaacgtctggctggtcttgcgcagcgtcgcggtaaaacgctttctgaaacgattgttcagctgattgaagatgcggaaaacaaagagaaatacgcgaataaaatgtcttctctgaagcaggatctgcaggcattgctgggtaaggaataactgacgaaagtcagttcaatttactaaaggcaaaaaaaaccccgcagcagcggggtttttctaccagacgagaacttaagcctgcggctgagttacaacgtctttgatacctttaacttcgatctctacgcgacgatccggagccaggcagtcgatcagtgcagcacgctgtttcacgttgtcacaggtgttgccagtaaccgggttggattcgcccataccacgtgcggagatcttgtctgccgggatacctttggagatcaggtaatcaacaacagactgagcacggcgctcggacagaccctggttgtaagcgtcagaaccgatgcggtcggtgtaacccagaacaactacggaaccgtctttcggatccaggttgctcagctggctgtacagctgatccagagcagcctgaccttccggtttcagggttgctttgttgaagttgaacagaacgtcagacttcagagtgaagtgcttggtctgtacttccggtgccggagctggagccggagcaactactggagctgcttcgccctgaccgaaacggtaggaaacacccaggctcagcatgccgttgtccggacgagtgccgatggtgtgtgcgtcaccgatgttgttggtccactggtattccagacgggtagcgatttcaggagtgatcgcgtactcaacaccgccagcgaagaccggagaaacgccggtgtcgtggtttttaccataaacgttggatttagtgtctgcacgccataccatgccacccagacgagtgtagatgtccaggtcgtcagtgattgggtaacccagtttagcggtcagttgaacgccctgagctttgtatgcaccgttttcaacgctgcctttgtacggcatacgacctaaccagtcgtaacccatttcaaagccaacatacgggttaacctggtaaccaccaaaagcaccagcgcccagttggttttcatgggtcgggccattgttgttgatgaaaccagtgtcatggtactgggaccagcccagtttagcaccagtgtaccaggtgttatctttcggagcggcctgcgctacggtagcgaaaccagccagtgccactgcaatcgcgatagctgtctttttcattttttgcgcctcgttatcatccaaaatacgccatgaatatctccaacgagataacacggttaaatccttcaccgggggatctgctcaatattaactctaccgatatcttcggcttatgccgagcacccctggcgatgtaaagtctacaacgtagttgaaaacttacaagtgtgaactccgtcaggcatatgaaaaaaaagtcttgtataaggtatgtttaatcttttttgtcagcgacaatttacagaagagaatcgcggaaaccgcttcagacaagcctccgcaaggaaaattagtcacgactgaaagcattggctgggcgacaaaaaaagttccaggattaatcctaaatttacttaatgatacaaattagagtgaatttttagcccggaaagttgtctcgtggcgtgagaggatgcgcttaccggacgcataataaaccccatagcgttaccttcatttgccgcatcaacaagttcagcatgctcttcttcagtcaaatcatctgccaaccaaccgatcaccacactgtaattgcccgtgcgtaaagcgcgaaccattgactccacagtgtggcaaggggagagctggctaatctgcattactttcgttaagggtagcccagatgcctgaacccattcccgactcagtttttgttgcggtgttaaccagagttgccagcgcgattgctgaccgagttgctgtaacaatggcaacagtagaagttgcgtcatcatgggctgatcttcgcgatagacaacttcactgataagcccggctgtagtgttttccgtagagacacgcgcaattttacttgctgcggatgagaacgacgaagaacgatgtgcatagcctgaagtgtacataatcaatccagcccctgtgagttactgtatggatgtacagtacatccagtgacaacaaagatcaaccctattttcggaaagagcctcgcaaattttgtcgttggtgacgggaaaacataaattaatcttgccccttaagaataagttgcctattttcgtagttaacggatccgttaatgtgaatcattcttttatgttatgattttaaaaggaattttatgaaaagcctctcctataagcggatctataaatcacaagaatacctggcaacgttgggcacaattgaataccgatcattgtttggcagttacagcctgaccgttgacgacacggtgtttgcgatggtttctgatggtgagttgtatcttcgggcttgtgagcaaagtgcacagtactgtgtaaaacatccgcctgtctggctgacatataaaaagtgtggccgatccgttaccctcaattactatcgggttgatgaaagtctatggcgaaatcaactgaagctggtgcgtctgtcgaaatattctctcgatgcagcgctgaaagagaaaagcacgcgcaatacccgggaaagactgaaagatttgcccaatatgtcttttcatctggaagcgattctcggggaggtggggattaaggatgtacgggcgttacgtatacttggggcaaaaatgtgttggttgcgactgcggcagcaaaacagtctggtgacagaaaagattctgtttatgcttgaaggtgccattatcggcattcatgaagctgcgctcccggtggcacgccgccaggagcttgcagaatgggctgactctcttacgccgaaacaggagtttcctgcggaacttgagtaatctggcgttgcagacgaccaatctcaggcagtaatgcaatcaataatccaacttgttgtacgaccagaggttctttgctgtctgcccgtggttcaagttgctgcatccgctgtttcaggctagctaatgcctcattgacgcgttcttcatcagcaggttgatgatgtaacgcgtcatcaacatagcaaactgcgtcatcaagaaacgccagaatttcaggattagttaactgctcccggtgagcaccgagggctgagatatagctggtaaacgtatggttaaggcacagcaaccgaaacgcggcttcgcgaatttgcggggtaacgttcggctcgctggacatatttgataccaccgacgccagctcagcatcacggttgtgtgcatcgcggcgggcaatacgatacgccagacggttatcacgcccctgatggtattgctccagtatggcatcgagataccgacagttggcctctgtggcgcgttcgagcatgcgcggcagattgcgaaactgccagtcaggccagatgtagctcactgccgcccacgcaatggcacaaccaatcagcgtatcgattacgcgaggtaacgctacttcaaaaccttcacccagtaagttaaaacacagtagcaccaaaagtgtgatgaacatcgttgcatgagcgtattgcacgttacggaaggcaaaaaagagcacgccggtaataaccagcagcaccagctgcccttccagtgatggcacaaaccacagcacaggaatgccaatggcgatacctaccagcgtaccaataatccttaacttcaggcggtggcgcgtggcgttatagtttggctggcagacaaacaaacttgtcagcaagatccaatacccgtgatgcattccggttatctgaatgatggcgtagccgaagcacaacaccagcgacattcttaccgcatgacggaagagggcggattccggcgtgaagtgacggctaagacgcagccagatatcactcaacccgtgcgggctgtcatcagcgagctcattttcgtcattattatggggtagtgcctgggcctgttctgattcaattgttgccagttgggcatcaatggcgcgtaaattgttcagcaaaaatcccagtgttttgagtaaatcggcgggtgcgccgttatcgcgcatccgctccagcgcagcatcaatatgcgtaaaagcgcgctcaaaatgcggatcatgttgataaggctgacgcaacaaaatacagcgtgacagttgctggcacgcctggccctgcatcgacatcagccgctgaaaacggaacagcacgtcgctgtggcgaaaatgttcacgcaatgtttgatactgaatatgagaagagctggcacgctcgtgaatatcctgtgcgacaaagtaataatgcagcgtgcgacgcgttccccgttgaccacgatcgccacgtaagcgggtcagcagcgagagtttcgtctgattcaatgtcgccatcagcagaccgttggcgagagccaaatcgtacagcggtgcctggctttgatcttcaatatcaggatcaaacatgcgcgacttgagctcaagataacgcgccagttgttcatagcaacgcgccaggttgtcctgcagcgggcggaccgggaacagcagatgaccaataagtgtcaggacgttgtaccagacggcaccggccagcagatacatcggctgctgataccagtgctcatacagtgatgttcccaacatagtgtaaatggcgatcagcaatgcaccgaaggcaattgttgcatagcgttgacccagaccgccgagcaaaatgaagccgctggtagagagcgttaagccaatcgcaaatagccagggccagggaaacagcaattctactgaggccgaggcgataaaaaagcagaacagcgtaatgatgaggttacgcaaacgtcccgccagtcggtcatcgagatcggtcagcgccgctgccaccatccccagcgttagcggaatcgtcagttttacatcacccagccaccacggaaacgctgtggttccacaaagcgcaataaaaatacgcgcgtaatacagccaggcgctgttccaggtatagcgtttgagcaaaggacttagcataaaggccatattagtggattattcaaaacgacgacgtgcattggcttcacgcgcagcttgcgctgtttctaccgataccacgcgacgaccaaccggccatagtgcaatagcggcaattttaaagttcgcaatgccgacaggaatgccaatgattgaaatacattgtgcgatgcccgttgcaatgtgcatcaggcataaccaccagccaaagaaaatcagccagaaaatattcaataccgtaccgccagtattcagcagcacatttttgccagccgggttcagttcatcgacatgaatagcttcattgccataaggcaccagagacagtttagtgatctcccagcaggatcgtgtcagcggtaaggtaaaaatcagcacaatactgaccagagtcgccaacagccagcccagagtggtggcaaatccgccaagcacaaagttcagaatgttcaaaacggtacgcataaaacctcgctttactgtggttttcagtaatgggcggcaattgtaacgtttttttgggctggagcacgttttctctgacggttacactgataagaaataatttcgtgtggatctacagagtcatggaactgaaagcgacaacgcttggaaaacgtctggcacagcacccttacgatcgggcggtgatcctcaatgccgggattaaagtctccggcgatcgccacgaataccttattcctttcaatcaattactggcgattcactgtaagcgcggtctggtatggggcgagctggaatttgtactgccggacgaaaaagtggtgcgtctgcacggcaccgaatggggcgagacgcagcgtttttaccatcatcttgatgctcactggcggcggtggagtggcgagatgagcgaaattgcgtctggtgttttacgccagcaactggatttgattgccacgcgcactggggaaaataaatggctgacgcgtgagcaaacctctggcgtgcagcaacaaatccgccaggctttgtcggcgttgccgttgccggttaaccgactggaagaattcgataactgccgtgaggcgtggcgtaaatgtcaggcctggttgaaagatattgaaagcgctcggttgcagcataaccaggcgtataccgaagccatgcttaccgagtatgcggattttttccgccaggtcgagtcttcaccgctgaatccggcgcaggcccgggcagtcgttaatggcgagcattctctgttagtgctggcaggtgcaggaagcggaaaaacgtcggtgctggtggcccgtgcaggctggttgctggcgcgtggtgaagcgtcccctgagcaaattttattgctggcgtttggtcgcaaagccgctgaagagatggacgagcggattcgcgaacggctacataccgaagacattaccgcacgcacgtttcatgcgctggcgctgcatattattcagcagggcagcaaaaaagttccgatagtcagcaaactggaaaatgataccgctgcccgtcatgaactctttattgctgagtggcgcaagcaatgcagcgaaaagaaagcgcaggcgaagggctggcggcaatggctgacggaagaaatgcagtggtcagtgccagaaggtaacttctgggatgatgaaaaattacagcgtcgccttgcctctcgcctcgatcgctgggtaagtctgatgcggatgcacggtggtgcacaggcagaaatgattgccagtgcacccgaagagattcgcgatctgttcagtaaacgtatcaagttgatggccccgttattaaaagcctggaaaggtgcgctgaaggcagaaaacgctgtcgatttttcgggccttattcatcaggcgattgtgattctggagaaaggtcgctttatcagcccgtggaagcatattctggttgatgaatttcaggatatctcgccgcagcgggcagcgttgttagcggcattacgcaagcaaaacagtcagacgacgttgttcgctgttggtgatgactggcaggcgatttaccgattcagcggtgcgcaaatgtcgctcaccaccgctttccatgaaaactttggtgaaggcgaacgctgtgatttagacacgacttaccgttttaacagtcgtatcggtgaggtggcaaaccggtttattcagcagaacccaggccagctgaaaaagccgctaaacagcttaaccaatggagacaaaaaagccgtcacgttattggatgagagtcaacttgacgctttgctggataagctctctggttatgccaaaccggaagagcgcattctgatcctggcgcgttaccatcacatgaggcctgccagcctggaaaaagcggcaacacgctggccgaagttgcaaatcgactttatgaccattcatgccagcaaagggcaacaggcggattacgtcatcatcgttggcttgcaggagggaagtgatggttttccggctgcggcgcgggagtcgattatggaagaggcgctactgccaccggttgaggatttcccggacgctgaagaacggcggttaatgtacgtggcgctgacccgggcacgccatcgggtatgggcactgtttaacaaagagaatccctctccctttgtggaaatactgaaaaatctggatgtgccggtggcgagaaaaccgtaagaaacaggtggcgtttgccacctgtgcaatattacttcagacggtccgcgagataacgctgataatcggggatcagaatatcgaccgcgtcgttgaaatgcggcgactggattatgaagtctgccgttgccacgttggtggcgaccggaatgttccataccgtcgccagacgcagcaaggctttcacgtcaggatcgtgcggcacggcatttagtggatcccagaagaaaatcaatacatcaattttcccttctgagatcaatgcgccaacctgctggtcaccccccattgggccactcaacatcgcgttgacgttcatgccggtcgcgcgggaaattaagttaccggtagtgcctgttgcatacagtacgtgttgttccagtaacggttgatgccgttccacccagctcatcagcatttgtttgcagtgatcgtgtgccaccagcgcaatatgtttccgcgcaggtaaagtgcgagtcgtcagttccataatgtacatccgtagttaactttcctacagattactgtaagcacttatcgctgcaagataaagaccgaaaaagcctgcgcacaggcacaaaaatctcaggaagatggttgtttttccgcccactgcaggaaagtatttcgcgtttgtgggtcagccagtttaaaccaatacttcagccgttgttctgtgagcacctgagactgcggtggaatagcatccagctcggaaacacccgaaagcagcgtactgtcatctgccatcatcgtggcaaattgcggtagtgaagcgcgtttcgcggatttgttatagcgttcaacctcgacctcataatcaatcgtttttgccgttgaggtaatggcgagaatatccagctttaccggaatcggcgtcgcatcgccatccaacaattcaaggcgcggcgcggcatcaaaatggttagcttcccgctcattctccaggcgaggcaggcgaaaattgacctggttgatgagctgggtattaaaactgaccaccagcggtggggagatatacagccgttcttcactattggaaagatgaatcgtcttctcaacgcgaaacactaactgatgcggtccattatccagttcaatgctgtccgcaccgcgcagcagagagctggaaaccttcttgccgtcgagtaccagaagatcgacatcggttgaaagccgcagcgtggtggcaaaaacggataccggcaaacataatgcaatcaaggtggtcacgatgccggttttcataggtagctcctgtcaaaagaccgcccgaataataatgtgtcaaaatttttctttaatcatacttactaacatatagacatatttcccgcttttgctctcattcattcgtattagctgcatggttggcatgtcggctttgtcgtacactttgttaaacagtctggaggaaataatgaaagaaaccgatattgcaggcattttaacgtccactcacaccattgcgctggtgggggcaagcgacaaacccgatcgtcccagctatcgcgtgatgaaatatctactcgaccaggggtatcacgtcattccggtttcgccaaaagttgccggcaaaacgctgctgggccagaaggggtatggcacgctggcagacgttccggaaaaagtcgatatggtcgatgttttccgtaattcagaagcggcgtggggcgtggcacaggaagctattgccattggcgcgaaaactctctggatgcaactgggggtgattaatgagcaagcggcagtactggcacgggatgccgggttaaatgtggtgatggatcgctgcccggctattgagatccctcgcctgggcctggccaaataaaaaatccccggaaggcaaaaaccttccggggatttgttcagggattagttacgcagacgcggggcctggagttgtttgcggatggtctgcgccagctcatccatggatggctgttcaggatgttcatcctgcaattcgctacttagctgggcttcagccaggtaggtatgaaccggtaggccgttatcgtcctccatcactacgtgataccacggagcggcgcgaagctcgtcattcaccgccagctcatcaggcgacggttcagagagcgaataaaccgggtcgatatccacgaccactccgagataacctaacagggaatggcggacctgctggccgataccgaatttgctggcaatcatagtcacctcccgggaaatctttacctttgatataagggtaaaattccacatttcaagttacatgacgcgacaggcaaaccctttcagatatagcccttccggataggtagcgatcaccggatgatcggctgcctgacggaactgctctataaattgtacatcacgaccggcatcaattgcggcatccgcgatgattttctgaaataaatcgctggtcatcagaccggaacaggagaaagtcaggagaataccgccttcattcagcagctgaatcgccagcatgttgatgtctttataaccacgacacgcgcccatcaactggcttttattctcaacaaacttcggcgggtccatcacgataacgtcaaatttttcaccgcgatcgcgataagtacgcagcaatttaaagacatcatcacggacaaactcagccttgctcagatccagtttgttcagctcaacgttctgccgtgcaatatccagcgcttcctgggaggtatcaacgctgacaacctggctgcaaccgcccatcagtgccgatacggcgaaaccaccggtataggagaaacagttcagcacacgtttattttcaacgtagcggcgggtagccaggcggctatcacgctggtccaggtagtagcccgttttgtgtccgtgctgaatatccaccagcagtttcattccgtgttcttcaatcggcagcagggcaggtggcaactcgccggtgacggggccctgggtcagctccattccttcttttttacgtaccgcgacgtcgctgcgatcgtaaatcgaacattccgggtacagcgtttgcagggcactaattaatgccgcgcgctgatattctgccccagcactcagcagttgcagcaccagaaaattaccgaaacgatcgatagtaatacccggcaggccatcagattctccggcgattaaacgatagctgtcgaggccatctttttgcgccagccagtcacgccatttttgtgcttgttgcaaacggcgggaaaaaaaagcaatgtcgatagactcagacgggtcaaacgtccagacgcgcgcccggatttgcgaagctggcgaataagcgccgcgtgctaaccattttccctgatgatcaacaatatcgatggtttcaccgaggctggctttaccttccatgcgggcaacggccccggaaaagacccacggatggcgacgaagtaatgatttttcgcgccctttggctaacactaaacgtacactcataatttacttttctgtcgatgcaaagaaatgggcgtcattgtccggagttttccatggatttgcaacgcgtccattaaggataaggagagcagcaatgtcgaaagtctgcataattgcctgggtttacgggcgagttcagggcgtaggatttcgctacaccacacagtacgaagcgaaaagactgggtttaaccgggtacgccaaaaatcttgacgatggcagcgtggaagtggttgcttgcggtgaagaagggcaggtggaaaaattaatgcagtggttaaagagtggcggcccgcgttctgcgcgtgtagaacgggtgctcagcgagccgcatcatccctcgggggaattaaccgattttcgtatccgttaaatacattttaccggttttggcaggccagcaattttggtggcttgcttagccggacctttcggaaacagtcggtataaatagcggctgttacctttttcttcgccaaatttattcgccatcgcttttaccagcatacgaatcgccggagaagtattgaattccagatagaaatcacgcacaaaacgcaccacttcccagtgttccggtgacagcgaaatcccttcgttctctgcaatcaccacagccagcggctcactccactggctgctttctttgagatagccttcggtatccgtttctatctctttaccttcgaagatcagcataattattactaccttaatcagactggcggcagtgtaacaaaaaacaaagccccgcataaagcgaggctatgaaagtgttagcgggtgagattaatcgcggctagcgaagcccagaatgctcagcaggctgacgaagatgttgtacagcgaaacatacaggctaaccgtggcacgaatatagttcgtctcaccgccatgaatgatgttgctggtttcaaacaagatagcgccagaggagatcagaatgaagaccgcgctgatcgccagatgcagagcaggcagctgcaggaagatattcgcaaccataccaatcagcaccaccacaatacccgccatcagcataccgccgaggaacgacatatctttgcgggtggtcagcacatatgcagagcagcagaagaacactaacgccgttccgcccagtgccatagcgattacgtcacccattccggcagacagataggtgttcagaataggtccgaggatataacccagaaaaccggtaaaggcgaatgcggagataatcccggtcggcttattcgccgttttataggtcaggaacatcaaaccatacatacccaccagcgtcagaatcagacccggagatggcagcatcagcaccgtactggcagttgcggtaatcgccgaaaaggccagcgtcaggctcagcagaaaataggtattacgcagcaccttatgggtgctaagcagtgatgtacggtcatgtgaagaactaacaatacgatccattgagtcactctctatgacagatgtaattaattaagcagcataatgataatgcgtaagggcacccagaagttttacccatctttacgcatttgatctggaacaggtttaacagcggattatcaggtcattaagcaaatataacgccctgagaatttcgacaggcaaaagaaaaaggggttagcatttagctaaccccttatcttatttggcggaagcgcagagattcgaactctggaaccctttcgggtcgccggttttcaagaccggtgccttcaaccgctcggccacacttccggaatgacgcgcactataaacatcccgatgcggcgtgtaaacccctaatttgtttgtttgcctgaaaaacagccaaaagtgcattgatagcgtgaaataacagcagattgatcatttcatcaccatgaattccttctcttttactcgtttagcaaccggctaaacatccccaccgcccggccaaaagaaaaataggtccatttttatcgctaaaagataaatccacacagtttgtattgttttgtgcaaaagtttcactacgctttattaacaatactttctggcgacgtgcgccagtgcagaaggatgagctttcgttttcagcatctcacgtgaagcgatggtttgccttgctacagggacgtcgcttgccgaccataagcgcccggtgtcctgccggtgtcgcaaggaggagagacgtgcgatatgaataacgaggaaacattttaccaggccatgcggcgtcagggcgttacccggcgcagctttctcaaatattgtagtctggctgccacgtcgctgggattaggcgcgggaatggcaccaaagattgcctgggcgctggagaacaaaccgcgcattccggtggtatggatccacggtctggaatgcacctgctgtaccgaatcttttatccgctccgctcacccactggcgaaggacgtcatcctttccctgatttccctcgattacgacgatactttgatggctgccgccggaacccaggcggaagaagtctttgaagacatcatcacgcaatacaatggcaaatatatcctcgcagtagaaggtaatccgccgctgggcgagcaggggatgttctgtatcagcagcggtcgaccgtttattgagaaactcaaacgtgccgctgccggagccagcgcgattatcgcctggggaacctgcgcgtcctggggctgcgtgcaggccgcgcgacccaatccgacgcaggcaacgcctatcgacaaagtcatcaccgacaaacccattatcaaagtacctggctgcccgccgatcccggatgtgatgagcgccatcattacttacatggtgacctttgatcgcttgccagatgtcgacagaatgggccgtccgctgatgttctatggtcagcgaatccacgataaatgctatcgccgcgcccacttcgacgccggagagttcgtccagagttgggatgatgacgctgcccgcaaaggttactgcctgtacaaaatgggctgcaaagggcctaccacctataacgcctgttcctccacacgctggaatgatggcgtttctttcccaatccagtctggtcacggctgcctgggctgtgcggaaaatggtttctgggatcgcggttcgttctacagccgcgtggtcgatattccgcaaatgggtactcattccaccgccgataccgtcggtttaaccgcgcttggcgtggtggcagcggctgttggtgtgcacgcagtcgccagcgccgttgaccagcgcagacgtcataaccagcaacctacagaaaccgaacatcagccaggcaatgaggataaacaggcatgagcactcagtacgaaactcagggatacaccatcaataatgccggacgccgcctggtggtcgacccgattacgcgcatcgaaggccacatgcgctgcgaagtgaatattaacgatcagaatgtgatcaccaatgccgtctcctgcggcaccatgtttcgcgggctggagatcatcctacaagggcgcgacccgcgcgatgcgtgggcgttcgttgaacgtatctgcggcgtctgtactggcgtacacgccctggcttcggtttacgccatcgaagatgctatcggtattaaagtgccggacaacgccaatatcatccgcaacattatgctggcaacgctctggtgccacgatcatctggtgcacttctatcagcttgccgggatggactggatcgatgtgttagatgcgctgaaagccgacccgcggaaaacctccgaactggcgcaaagtctctcctcttggccgaaatcatcccctggctatttcttcgacgtacaaaaccgcctgaaaaaatttgttgaaggcgggcagttggggatcttccgcaatggctactgggggcacccgcagtacaaactgccgccagaagctaacctgatgggctttgcccactatctcgaagctctcgatttccagcgtgaaattgtcaaaatccacgcggtctttggcggtaaaaacccgcatccaaactggattgtcggcgggatgccttgcgccatcaacattgacgaaagcggcgcggtcggggcagtcaatatggaacgcctgaacctggtgcagtcaattatcacccgcacggcggacttcattaacaacgtgatgatccccgacgccttagccatcggtcagttcaacaaaccgtggagcgaaatcggcactggtctttctgataaatgcgttctcagctacggcgcattcccggatattgccaacgactttggcgagaaaagtctgctgatgcctggcggcgcggtgattaacggcgacttcaacaatgtgctgccagtggatttggttgatccgcagcaggtgcaggagtttgtcgaccacgcctggtatcgatatcccaacgatcaggtcgggcgtcatccgttcgatggcatcaccgacccgtggtacaaccccggcgatgtcaaaggcagcgataccaacattcagcagctgaatgaacaggaacgctactcgtggatcaaagcgccacgctggcgcggtaacgcgatggaagtggggccgctggcgcgcacgttaatcgcttatcacaaaggcgatgctgcgaccgttgagtcggtcgatcgcatgatgtcggcgttgaacctgccgctttccggtatccagtcaacgttaggccgcattttgtgccgcgcgcacgaagcgcagtgggccgcaggtaagttgcagtatttcttcgacaagctgatgaccaacctgaaaaacggcaatctcgccactgcttccacggaaaaatgggaacctgcaacctggccgacagagtgccgtggtgtcggttttaccgaagcgccgcgcggggcgttaggccactgggccgccattcgcgatggcaagattgatctctaccagtgcgtggtgccgaccacctggaacgccagcccgcgcgatcccaaagggcagattggcgcttatgaagcggcgctgatgaacaccaaaatggcgatccccgagcaaccgctggagatcctgcgtactctgcacagctttgacccgtgcctcgcctgttcaacacacgtgctgggcgacgacggtagcgagctgatctccgtgcaggtgcgttaacagcgaaggagaatcatcatgcaacagaaaagcgacaacgttgtcagccactatgtctttgaagcgccagtgcgcatctggcactggttgacggtgttatgcatggcggtgttgatggtcaccggatactttatcggcaagccgctaccttccgtcagcggcgaggcgacgtatctgttctatatgggctacatcaggttaattcacttcagcgccgggatggtttttaccgtggttttgctgatgcggatctactgggcttttgttggcaatcgatactcccgcgagctgtttatcgtgccggtatggcgtaaaagctggtggcagggcgtgtggtatgaaatccgctggtatctgtttctggcaaaacgtccgagtgccgatataggccataatcccatcgcccaggcggcgatgttcggctatttcctgatgtcggtctttatgatcatcactggttttgcgctgtacagcgaacacagccagtacgctatttttgcgccgttccgttatgtggtggaatttttctactggacgggtggcaactcaatggacattcacagctggcatcggctggggatgtggctgattggcgcgtttgtgatcggtcatgtctacatggcgctgcgtgaagacatcatgtccgacgacacggtgatctccaccatggtcaacggctaccgtagccacaaatttggcaaaataagtaacaaggagcgttcatgagcgagcaacgcgtggtggtcatggggctgggcaacctgctgtgggccgatgaaggcttcggcgtgcgggtggcggaacggctgtatgcccattaccactggcccgagtatgtggagattgtcgatggcggtactcagggactgaacttgctggggtatgtcgaaagcgccagccatctgttgattctcgatgccattgactacgggctggaacctggaacgctgcgaacctatgccggagaacgcattccggcttatctcagcgcgaagaaaatgagcctgcatcagaacagtttctccgaagtgttggcgctggcggatatccgcggacatctgccagcacatattgccctcgtcggtctgcaacccgcaatgctcgacgactacggcggtagcctgagcgaactggcacgggagcaactgcccgctgcggaacaggcggcgctggcgcagcttgctgcgtggggaattgtgccgcaaccggctaatgaatcgcgctgtctcaattatgactgtctgtcgatggaaaattacgaaggcgttcgcttgcgccagtaccggatgacacaggaggagcagggatgagcaacgacacgccatttgatgcgttgtggcaacgaatgctggcgcgcggctggacgccagtcagtgaatcccgtcttgacgactggcttacgcaagcgccagacggcgtggtgttattaagcagtgacccgaaacgcacgccagaggtcagcgataatccggtaatgattggcgaattactgcgcgagtttcccgactatacatggcaggtggcgattgctgaccttgagcagagcgaagccatcggcgatcgctttggcgtctttcgctttcctgccactttagtgtttaccggcggaaactatcgcggcgtgctgaatggtattcacccgtgggcggaactgataaacctgatgcgcgggcttgtcgaaccgcagcaggagcgtgcctcatgagcgaaacttttttccatctgctggggccaggaacgcaaccgaacgatgacagtttcagcatgaatccactgccgatcacctgtcaggtgaatgatgaaccgagtatggcggccctggagcaatgtgctcacagcccgcaggtgattgcgctgttaaacgagttacaacatcaactaagcgaacgccaaccgccgttgggcgaggtgctggcagtcgatctgttaaatctcaacgccgacgatcgtcactttatcaatacgcttctcggggaaggggaagtgtcagtgcgcattcagcaggctgacgacagtgaaagtgaaatacaggaggcgatcttctgcggattatggcgggtgcgcagacgtcgcggcgaaaagttgctggaggacaaactggaggctggctgcgcgccgctggcgttgtggcaggcggcaacgcaaaatctcttgccgacagattcgctgttaccgccgcccattgatggcctgatgaatggcctaccgttggcgcatgagttactggcacatgtacgtaaccccgacgcgcagccgcacagcattaatctgacgcaattacccatcagcgaggctgatcggctttttctctcacgtctctgtgggccgggaaatattcagattcgtaccattggctatggcgagagctatatcaacgccacggggttacgccatgtctggcatttacgctgtacggacaccttaaaaggcccgttactggaaagttatgaaatctgcccaataccggaagtggtgctggcagcgccagaagatttggtcgactctgcgcagcggcttagcgaggtatgtcagtggctggcggaagctgcaccgacgtaaaaagacggtaagtatcgctttcagtcttatgaatatcgcaatcggcgaatacctctggtcgtagagtttcaggataaagagggagatctaccattatcgggttatttttctctcttcgcctacaggagtgcgcatgtgggatgtcattgatttatcgcgctggcagtttgctctgaccgcgctgtatcactttttatttgtaccccttaccctggggctgatttttttgctggctattatggaaaccatttacgtggtcaccggcaaaacaatctaccgcgatatgacgcgcttctggggtaagctcttcggtatcaattttgctcttggcgtggctaccggcctgaccatggagtttcagtttggtactaactggtcattctattccaactatgtgggcgatatttttggcgcaccgctggcgatggaagcattaatggccttcttcctcgaatccacctttgtcgggctgttcttcttcggctggcaacggctgaataaataccagcacctgctggtgacgtggctggtggcgttcggttcaaatctctctgcgttgtggatattgaatgccaacggttggatgcaatacccgaccggtgcgcattttgatatcgacaccctgcgtatggagatgaccagcttcagcgagctggtctttaatccggtcagccaggtgaaatttgtgcacaccgtaatggcgggctacgtgaccggggccatgtttattatggcgatcagcgcctggtatttactgcgcggacgggagcgcaatgtcgcattacgctcgtttgccatcggttccgtcttcggtactctggcgattatcggtaccctgcaactcggagacagttctgcgtatgaagtcgcgcaagtacaaccggtaaaactggcggcgatggaaggggagtggcaaacggaacctgcacctgcaccgttccatgtggttgcctggccggaacaggatcaagagcgtaacgcctttgccctcaaaattcccgcgctgctagggatcctcgccactcactcattagataaacccgtgccgggtctgaagaatttgatggctgaaacctacccacgcttgcaacgcggacgtatggcctggctgttaatgcaggaaatatcgcaaggcaatcgtgagccgcatgtgttgcaggcattccggggactggaaggtgacctgggctacggcatgttgctctcccgctatgcgccggatatgaatcatgtcacagccgcacagtaccaggcggcgatgcgtggcgcgatacctcaggttgcgccggtattctggagtttccgcatcatggtgggctgtggttccctgctgctactggtgatgctgattgcgcttgtccagacgctgcgtggcaaaatcgaccagcatcgctgggtgctgaaaatggcgctctggagtttgccgttgccgtggattgcgattgaagccgggtggtttatgaccgagtttggtcgtcagccgtgggcgatacaggacatcttaccgacatactccgcgcactccgctttaaccacaggacaactggctttctcactgatcatgatcgtagggctttacaccctgttcttaatcgccgaagtctacctgatgcagaaatatgcccgtctggggccgagcgcgatgcagagtgaacaaccgacgcagcaacaggggtaaaggagaaaatcatgtttgattatgaaacattgcgcttcatctggtggctgctgattggcgtgatcctggtggtctttatgatctccgacggatttgacatggggatcggctgtctgctgccgctggtggcgcgtaatgatgatgaacgccggatagtgataaacagcgttggtgcacactgggaaggcaaccaggtctggttgatcctcgctggtggggcattatttgccgcctggcccagagtgtatgcagcggcgttttccggcttttatgtggcgatgatcctggtgctgtgctcactgttcttccgcccgctggcctttgattatcgcggaaaaatcgccgatgcacgctggcgtaaaatgtgggacgccggtctggtcatcggcagtctggtgccgccggtagtcttcggtatcgccttcggcaacttgttgctcggcgtgccgtttgccttcacaccgcaattacgcgtggagtatctcggcagcttctggcaactgctgacgccattccctttattgtgcggattgctcagccttgggatggtgattttgcaaggtggcgtctggttacaactgaaaactgttggtgtgattcatctgcgttcacagctggcgaccaaacgcgctgcactgttggtgatgctgtgctttttgctggcgggttactggctgtgggtcggtattgatggctttgtactgctcgcccaggatgctaacggtccttccaatccgttaatgaaactggtggcagtgctacctggtgcctggatgaataattttgtcgagtcgcccgttttgtggatcttcccgctgctgggattcttctgcccattgctgacggtgatggcgatttatcgtggtcgcccgggttggggatttttgatggcatcattgatgcaatttggcgtgattttcacggcaggcatcacgctgttcccctttgtcatgccgtcaagcgtgagtccgatctccagcctgacgttgtgggacagtacttccagtcagctgacgctgagcattatgttggtaatcgtgctgatatttttgcccattgtgttgctctacactctctggagctactacaaaatgtgggggcgcatgacaacagaaactctccgccgtaacgaaaacgagttgtactaaggagcagaaacaatgtggtatttactttggttcgtcggcattttgttgatgtgttcgctctccacccttgtgttggtatggctggacccgcgtctgaaaagttaacgaacgtaggcctgatgcggcgcattagcatcgcatcaggcaatcaataatgtcagatatgaaaagcggaaacatatcgatgaaagcgatcttaatcccatttttatctcttctgattccgttaaccccgcaatctgcattcgctcagagtgagccggagctgaagctggaaagtgtggtgattgtcagtcgtcatggtgtgcgtgctccaaccaaggccacgcaactgatgcaggatgtcaccccagacgcatggccaacctggccggtaaaactgggttggctgacaccgcgcggtggtgagctaatcgcctatctcggacattaccaacgccagcgtctggtagccgacggattgctggcgaaaaagggctgcccgcagtctggtcaggtcgcgattattgctgatgtcgacgagcgtacccgtaaaacaggcgaagccttcgccgccgggctggcacctgactgtgcaataaccgtacatacccaggcagatacgtccagtcccgatccgttatttaatcctctaaaaactggcgtttgccaactggataacgcgaacgtgactgacgcgatcctcagcagggcaggagggtcaattgctgactttaccgggcatcggcaaacggcgtttcgcgaactggaacgggtgcttaattttccgcaatcaaacttgtgccttaaacgtgagaaacaggacgaaagctgttcattaacgcaggcattaccatcggaactcaaggtgagcgccgacaatgtctcattaaccggtgcggtaagcctcgcatcaatgctgacggagatatttctcctgcaacaagcacagggaatgccggagccggggtggggaaggatcaccgattcacaccagtggaacaccttgctaagtttgcataacgcgcaattttatttgctacaacgcacgccagaggttgcccgcagccgcgccaccccgttattagatttgatcaagacagcgttgacgccccatccaccgcaaaaacaggcgtatggtgtgacattacccacttcagtgctgtttatcgccggacacgatactaatctggcaaatctcggcggcgcactggagctcaactggacgcttcccggtcagccggataacacgccgccaggtggtgaactggtgtttgaacgctggcgtcggctaagcgataacagccagtggattcaggtttcgctggtcttccagactttacagcagatgcgtgataaaacgccgctgtcattaaatacgccgcccggagaggtgaaactgaccctggcaggatgtgaagagcgaaatgcgcagggcatgtgttcgttggcaggttttacgcaaatcgtgaatgaagcacgcataccggcgtgcagtttgtaatgcataaaaaagagcattcagttacctgaatgctctgaggctgatgacaaacgaagaactgtctaatgcgtagaccggaaaaggcgttcacgccgcatccggccactttcagttttactctttctcggagtaactataaccgtaatagttatagccgtaactgtaagcggtgctggcgcgtttaatcacaccattgaggatagcgcctttaatattgacgcctgcctgttccagacgctgcattgacaaactcacctctttggcggtgttcaagccaaaacgcgcaaccagcaggctggtgccaacagaacgccccacgaccgcggcatcactcaccgccagcatcggcggcgtatcgacaatcaccagatcgtaatggtcgttcgcccattccagtaattgacgcatccgatcgcgcatcagcagttcagacgggttaggtggcacctgaccgcgagtaatcacatcaaagcctcctttgccaaaatgctggatcactttgttgagctcatctttacctgccagatattccgacaagccatgttcattactcacggtaaacaggttatgcgaataaccacggcgtaagtcggcatcaataaataacactttttgatcggactgggcgatcaccgctgccagagttgaactgacaaacgttttaccactgtctggcgtcgcaccggtgatcattagaatgttattctccgtctccatcatagcgaaatgcagactggttcgtagcgcacgtacggcttccacagcagaatccgccgggttatccaccgccaggaaggggatatttttagtacgatggcgctgctgattagaaaataaatttttcttacgcagacgggtgcgtttatccagccactcggacattgggatagtggcataaacgctgatgccgtgctcttccagttgttccggggcttctacaccacgacgcaacatcgcacgcgccagcacggcacccacagaaataaacaggccaagaataaaaccaagcaccacgttcaacgcttttttcggtttcactggctgcggctgagtgactgccgggtcgataatccgcacgttaccaatggcactggatttcgaaatactcaactcctgctggcggttaagtaattgcagatataccgcacggcccgcttctacgtcacgacttaaacgcaacacttcctgttgggtggaaggcattgccgatacccgcttattcaggcgtttgcgttcttgctccagcgtctggcgtttttccagcagcgcacgataagttgggtgatctttcttatacagctgggagatctctgcctcgcggaaggtcagctcattgagttgattatcaacgttcacaatctgctcaagaacggctttggcttccaggttaaggtcaaccgaatcgcgctgctggcgataaacgttgagtttttcttccgcttggtccagctcgctgcgcacttcaggtaactggcgctgtaagaattcaaggctttgtgaatcctgcgccgcctggcgagcgatattctgttgcaaatagttgttagcgatgctgttcagaatacgagtaatcaactggggatcatcaccagtcatggtaagttccagcatcccgctttctttactgcgttcgctaacggtaaaggtttcctgcaatgcgttaatcgcttccagttcggtacgctggctcaggacaaactgtgttcctggtttggccttaatgtccgcgatagtcagcgcaacgccatctttttccagacgctggccgaccataccattgacggtgaactcttcaccttccagtgtatagtggccgttttccccaaccgtgagtgtcagttgctgatcctgaccattcagttgtggaatatgcatccagctgatcgccagctcacctggtttttctttggttaatctcgcccagccgcgacccacaatcggaaaatacttctgctcaactatgtcgcgcagattcagttcagcaatggttttaccgagaatcatgcgcgattgcagcagttggatctccggtgcagactcgggcgatgagttagggatcatatcgctcaggccgctgagaatggcgttgccctgtttttgctcaacctggaccagagtatctgcctgataaattggtgtgcttaacagcgagtaagcgacagcgatcagcgtgaataacgcggtcacgctgataataaacttacggtgatcccataactcgccgaccagacgaagcagatcgatctcattttcctgagtgctgcctggtggcgtattcatatttttagttgtcatcgtattttataaactcaaattaccggctgaggcgcttcgcccattcctgactggcgcgctccaacataccgtagacatgttcaaatgcgtcctgacttttacgatagggatccgggatctctttctgttccagccattgcccaaacagcattgtcttcccgcggacctcgggagcaattgcggtaacctgagcaatatgttccgactccattgccagaatcagatcgtaatttcgtgccatctcagcagtgagcttacgtccggcatgtccttcaagagatacgccatgattagcggcaacatctgccgctgtcgcatctgcagggtgttttaccagaccatgaacacctgccgatttgacttttacgcccggcagacgtttacgcagcaagcgctcgccaatgggcgaacggcaaatgttgccggtacaaaccaccaggattgagttaaattttagttgggccatgtttgaatccaccgtgaagtctctgtcaggtcatgcaccccggaaatcgtcggtaccagcagagaaatcacacggttccaacgagccagcggcgcggtagtgacataaacaatgtcgtaaggttcaagctggaattccgttccgagtatcattgccgatgcgtccttcgcattcagctgataaatattggcgattttgccattctgcttgttttgcgttgcacgaataacaaaaatccccgtcgcatcagcgacatcctgattcataccctcagcgttacccagcgcttccgccagggtcataccgctgcggtccattttcagcgtgctctgtttacccacttcacccatcacgaagactttcagatcatcgttgcgcggaataaataaaatatcgcccgggtgcagcagtttgttctggcgcaagtcgccacgctgcatcagcgcatagaggttcactttggtctttacgccattctgggtgagcaccacgttgcgccagtctgcatctgcggtcagaccgcccgcggcgttaatcgcatccatgatggtcagaggaatattggtaatcggctgctgacccgatttgctgacttcgccggtgacgtacgctttttgcgatcggaacgccgcgacgctgacatcgacttgcgggctttcaatgactgaatcgagacgcgctgtaatctcgttgcgtacctgggtaagtgttttcccggccactttcaggcgaccaatataggggtagaaaatcgcaccatcggcgttaacccagttgccggtatcactggcgctacggtattgccctgcgggggtggttagttccgggtgatcccagaccgtaaccatcaacacatcaccaatcccgatacgatattcatagtttgcgatttgctgctccagctccgggttagcctgcgacataatcggtttggcgcgcaactgatcaatcaatcctggcgtgacgggatagatattgaccattttgtccaggtcatactgattgtcaggtagttcaatgacatccttgttactggtcgataaattctgaccaggaacaagggtacatgctgtcaaagacagaacagccaatgtcagtaccgaaaacttaaaaatgttctttttcattggtttatatttatcagtcaatgtaatgttatgaattacgtcaggttattgtccaaccggtacttctcgctctgccgtcattggatagagctggtatttgcgtgacagcatttgtccaccatcacgcgtcaatggtgtccacgaaaccaccgcgcggttgcggttaggtccaatggtcatcaagtcgaatggaatcgagatataaaaacctttactaaagccgccttcgccgtagtcatctttagatacgttactgattgccgcccatacccctaccgccacgccgctgtcaaagcgtttggcgacgtcgatcgttgcgcctttatcttttgccagatattgcccaacgctaagtttcatcagtacgccattgagcgtcggcgggttccagtaagccgtcacgaaacctgttggcgtggaataatcggtgaaacgcatcatgttgtcccagtcacgttgcttcacgtagttaacgtccacacccagcgcccagcaggcatctagcgggcgataaagcagctcggaaccgacaccggcgtacatcgtttccagataaccgccatacacctggccatagaaaccattgcctaagtcagcaaaatagttcgcctgcaagttgttgagataaacgtcattgcgaacgtagtcacggatatgcgtgcgcacgcggggcagggtagagtccgcgggcaacagcgaagacttaaacttgtcgtagttgttgtaaatattggtgaaaataccgccatcaagcagcaggtggtcggtaaaccagtagcgggcactggacatcagccccagctggaacatatagaaatcttccgggccgcccagcgactgtgaaagtgttgggttgaaagagtagctaaagcgatcttcacgaatacggtagccccgaccaaaggcagaaagatcttcagcttcaacacgttgttgttgcagtggctctgattgaccaggcgctgtacctgccagctgtttgcgcaggctggctacgtcggtttcggtagtcaccatcgccatatgctcgcgcttttgcgtcacgctaatcttctcaacgccttgcggcaggttattcaccagaatccggttggcacgatcgaccgcttcacgagagtcacggtatttgtattgctgaccagacatatacagtgtcttatcgcgtagctgaatttctggcgcgtcaaagcccgcgttatacttcagggcggtaagttggtttgctaccgtggtgtactgcaatccttcagattcaggcgcaggttgatatgccggttttggcgtatcgcgcagggcagggcgcagatcgttgaaattggtccgtaacgtgaagccaaacatcaacgtgttaccgcgttcataactcaggttgagatctgcccagctggcagcgcgataaactgcgccgacgttgaaatggcttgcctgaggcagtttgccagcgaaatcattctggtaattgtttccatcgtattcgagtttcagacgcaggggattccacggcgtttgatactcaatgccgccaaagatggaagccgggccacgaaagatatcgctaaagctgatatcgcccgcatcgtgagactctgcgcgatgacaatatttatcgctcacccggcaaaacgggttggtaatattgcccgcattaccggcgtagccccatgccatcccgagggtgaaatcaaatggccccgcttgcttgctggccaccagatactcaccgtcaaacagacccgtaccagcaatatcacgtttaccaaacgccacttgcggtagccagtaaccttcttcccacaggcgaagtttaaaatcgaatgatttgtctttgtatgactgatcgccgctgaaatcttcccactggctatatttgcgtgtgcgcacatccgtataacgaatggtgccttccagccatgggaacagcgccacggaggtggagtagaaccggtattgatcgttatcccggtagttgacgctgaattcaccttccggtgcgatgcgcgcatttggcatctgcaacaatcctgtgccgccaaagtctgattgcgacgaacccagcggatccgggtaggttaatacttcagcatgacaggcactggagacggcaatggccaggcagcttaaaagataagaattcttcttcatcagtcaggaacacgttgcgttaaaacagacacaatctggtcatttaaatcagcatatttttcgggcagtacatgcgcagaaaagcccaaccaaagctggctgccaggcggtggttccacatgtcttttattccacagggcaacaggggcgacgacagtctcaccctcaggcgtaatcaccataacgttattcttgtccgcgcctgcaaggcgggggtgatcttgcagataatcggtaacgctacggcctgcctgccagggcaattgcccggccccagaaaccgcacccagcagagtaatagtcaccggacgctgtacggtatagagcgtatagtccccgaccaacgggggattgctgttctcatccactcgtacaaaatcagggtccagtttgaccggtaagcgaccagtgatattgagattgagtaactgctggcgcacggatttaatcgttgccgccacatcgtcgtcagcttctgcttcccaggaagcaagctgtgccatgacatgttggtagtctttaagcgctttagctttcgccgcagagtcggtcagcaaggcaccaggccaccagaggcgatcgcgcagttgcggttgtgtcaccaactggacaacattttccacggggccaacggaaagtgtctgttgttcgccaggcagataaatagtcaccgttccttgcgcaaaggcatggggtgtcattacgtaaagtacgctggcaatgaaatacgactgtaatttattcatggtgcgggtttaagaaacgtcatttctacgggaataacccctgcgcctaacatttgccgactttgacgaacctggccagtagccgaatcgacccagaatgtgttttgccactgtttttctggccgcgtggaagtcacctcttcctgccagacattacacagcacattgcgacccgcaatattcagcgtctctaatccagcaaaggaaaaagtagaactcagggtcgcagagcgaaaatggttgtcttcactccagagaatatcgcgcgtccagcggctgccatcttttattgccagcgcgttacgcagagggtcctgcccggaatttgtcacttccagcagattattattaagtttgacggtttttaaaagacgtccattgtgggtaaccagcatggcgttatcctgggataaccatttgctttgttcttgttctatatatcccagtaccacaaagattcgttgcccttcattaaggcgtaaatacatagtggaataaggcaacgcctggatctgctgatccgctacggtgatatcctgattatcgaaaaggctggcgcgaaatgtatcgaccatactttgctggctgtgcgtacatcccgcaagaaatagtgcgaaaatcgataaaataagagggcgcacctttaatccttgaaaggttaattaaaaaaatgcaaatctctaaagcccggtacgaatatcgcaaccgggtatcatttaactttaatttcgacgcgttaaagcagtattagcgtgtagtggacgtggtggttgaggtgttatgagaaccgccatcgccactgtcatttgctgcaacaactgccaacgtcgccacaccaacagccgttgccacaccgacaactgtcgccgtgccgacagcgccagcagccacgccaccagtggtagtagcagtcgtggttgcgccggtagtggtcgttgtggtgccagtagtacccgtcgttgcctcggtcccgtttgttgcttcaggggcagcaaacgcagctggcgtcgtcaacatgaaggccataaggattgcagaaagcttgtgtttcataacttttcctttattcatcgcatggacaatacgggtgatgctgccaacttactgatttagtgtatgatggtgtttttgaggttctccagtggcttctgtttctatcagctgtccctcctgttcagctactgacggggtggtgcgtaacggcaaaagcactgccggacatcagcgctatctctgctctcactgccgtaaaacatggcaactgcagttcacttacaccgcttctcaacccggtacgcaccagaaaatcattgatatggccatgaatggcgttggatgccgggcaacagcccgcattatgggcgttggcctcaacacgattttccgccatttaaaaaactcaggccgcagtcggtaacctcgcgcatacagccgggcagtgacgtcatcgtctgcgcggaaatggacgaacagtggggatacgtcggggctaaatcgcgccagcgctggctgttttacgcgtatgacaggctccggaagacggttgttgcgcacgtattcggtgaacgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggtataacctgaatctgaggcagcacctggcacggctgggacggaagtcgctgtcgttctcaaaatcggtggagctgcatgacaaagtcatcgggcattatctgaacataaaacactatcaataagttggagtcattaccgacaatacgtacgcttgagatcaggattgtctactttgagtataacatccttgtgaaatctccctttcctcataccgcttgcactatatactgcgggtaggaaaggcgcgcagagggaaatataagattgttaactatccccctctggaaatacgacttgtgagcataagataaatcttagcaaaatacaaattaaagataaggaaattgttacgaaagctattaattattgttggtaatatagtttcaagtggtactataactggctgttaaatggcatttataactattaggtgcagagatattcgcttaaatggattagtttctttgtggaaaagtaactgatgttataatgtatgatgttgactatttcactattccaataaaaccagtcagctttaaacaagcagcgtcatattaagagagataaacatttgccgctgttggtcctcgcaggccatttacgcggcaaaattccacacgtaatcctggtataagcacttctgcgtcgcggggagtgaatgcggaaatatggacctgaacttctttacgaccgtcggaggggataatgaatcctttgccgcttttgcgatcaaaggttttgacaattcctgtcattttacgggacaaacaaattccttactgaaaatactgcgctgcactatacggggttaataaaataaagccagcgatatttaagaccgccggacggctaaaataaaatttgcttaatctcaattatcatgcgttaatagctgcgtcggtttgaaagacagacagcatacaaagtagtttactaaagcagttctcattatcaggcattatccccttcttttgagtctctctcctgaacactaagtagtttctgtattaaagccctgtttgccgaaaggcccaaaatgaaggaagtaaaatatgtctaataaaatgactggtttagtaaaatggtttaacgcagataaaggttttggctttatcactcctgatgatggcagcaaagacgttttcgtccatttcaccgccatccagagcaatgaattccgcacgctgaacgaaaatcagaaagttgaattttctattgagcaggggcaacgtggccccgcggcagcgaacgttgttacgctctaaggttgccattattactcaacatctccatttccgctgtccatgttgtcatggttcacagtaccgcacatcggcattcgatgtgacggagcgaaaccctttgggcgctaagtgtattttttgtaaatcgacgatgatcacctttgataacgtcgcgctgcaaatacgcactgaccatgcgccgctggatttcacaaaataatatcaggctccctcgtggagccttttttatatctgccttatttttcttcaacgctgtatgtatagtaagcgataacctgttgattattgaatctttcggggagatggcttataacatttcttacctgaccagggtaccgggaaccaacaccttactggcgtgttgctgtcttttaagaccagaagaggttaacagtgaatattgaagagttaaaaaaacaagccgaaacggaaatcgccgactttatcgcgcaaaaaatcgccgagctgaacaagaatacagggaaagaagtctctgaaattcgcttcaccgcacgagaaaaaatgaccgggcttgaaagttatgatgtcaaaatcaaaataatgtgattttgtgaacatcaccccgtgcgaggtgatgttccgcttgttgctaatttagtgaccaatcattggcgcttgtggaattaagcgtcggtacaattcctccggcaccgggctttgccatactcccgcatacattgcgtaaccaatcaccgcaaacataatccccagaaccagtagcgtcattaaccagccagacaacgcaaaggcttttttatttgccgcaggtttttgcagtgaaaaggtcaatgttgaggctaccggacatgactctacgcaagtcatacagccggtacattccactgttcgtacctgaattaatttatcgaccgggatccgtgatgggcaattttttgcgcatttgccacagtcgatacaactttcggcattgcgacgaatcttaaacggcgacaatagcgaaaccacgcccatcagcgcgccatatgggcaaagataacgacaccaggcatggcgaataaacaggctggcaatcagcaaaacggtcacgctgattaatgtcgcggtccccatatgacgaaagaaatcgagcattttaacgtccatcaccacgctgtagggcgacaacataaaatagtgaatcgcctgagcgggcatcaataacgcgatatagataaaaaaactcaacagcaaatacttcacgccgcgcagaggaatatccagccagcggggaaggacacattgccgaccaaacagtttgttaccgagatcgccgattaattcagaaagcgtaccaaccgggcataaccatgagcaaaaggcctttttgagtaatagactgatgacgataaaagcgaccaataacagcatcgcggcggcgtggacggacggtaactgacctgttacaaggctatatttcagattcatcagcccggcaatcggtagccagccttcgatacctcccggtctggcgacaaatgtcgtgctacttgccgtttcgtaatagcgcacccaataccagaacgtgatggcaatataaatattcattgccaacagtaataattgcgtcgctttacgccaggtcgtggcattacgccagtcattccacggtaatttgccgcccgtcgtgcctggccgccgctgccagcgggttcttttattctctgccatgattttgccagtccgttaagttgtataccaaatgccactattctagttgttcttaactggctgatattgattcaaatcgcgttcaggtctttcttatgcaaccatgcttccagagcggcaacactgcgtgtaatttcttcgtgtggaaggggggcagataatggctgctgctccagttgtgcgcatagctggctggcgatatgcattcccagactcgagcaactgctttttagctgatgcgcggcacgctttattttctcgctatcctgactggcgcgggcaatgtcgatttcatcgagaagcggcagggcatgttgtgtaaataataccagccattcgtggatcttctccgtccccattaactgagcatcttcattgagttgcgatacatccagcgattgatcattattgacttgcagttggagatagtgcgccagtaactgaccgagcacttcacgcggcaccggtttagggataatcccgcggaataatgaactggtacgctggcgcagcgtttcgtcaatgacatgggcgctaaagccaatcaaaaccagcgacggatattgctgtgccagttgtcgggcaagcgtaatgccgtcgatatccggcagatcaaaatccaccagtgcggcagcaaacggttcgctattttgcagtgtctctaaagcctgcgcggcattgccaacagcaacaatctgcgcaccactggttttcagcatctcaatggtaattcgctgggttagcgggttatcttcaattaacagcaaacgtaaaccgtcaagacgcaccgcctgattgactgtttttggcacgggtgccgtggcaacacgtaacggcaagcgtaaacaaaaacagcttccaacctccggcgtgctggtggcgctcagttcgccgcccatcgcctgggccagacggctactgatagtcagtcccagcccggtgccgccgcgtttgccgcttacctgcacaaatggctggaagatttctgccagtttcgcgggatcaataccgcagccgctgtcttccacttcgaccagccattgctcgccatcagtgcgactacgcaggataatgtacccttcgtcagtaaaacgcagggcgttgctcaacaggttggttataacctgacgaatacgtcgtggatcgcccattaacgcgcacggcatatcatcggcaattgccgttgccaggcgaatcgggcgacctttcacccgtccgctcattaattgcagggtactttccagcagcgggcgcggttcaaagggctcatcgctgaccgaaacattcttgccacctgcttcgatagcggaataatcgagaatatcgttgaggatggtcagcaacgattcaccagagtcagtaattgcccgcaaatcatcacgctgggcgttaagtgcggggttatctgccagcagttgagcagtgccgagaataccgtacagcggtgtgcggatctcatggctcatcgccgccagaaacgccgattttgcctggctggctttttctgcttccgcccgtgcctgtcggtgttctatcaccagttcctgcaattcagctgtacgcgctttgacctgcgccgccagctgttcgcggtggcgattcagtgcatgaacattgctgcgaaacgcatccatcagccgcccgatggtatccagctcccgtacgccagcggtttccgggaaaggggagtcaatatcaccgtccagcagccgttgcagcgcctgcgtttgttcggcaagtggacgcgtgactgagcgataaaccacgcgccagaggatcagaatcagtgcgcaaagtgaaaccatccccagcaataacaggctgtattgcccgcgtgcactcgctttttccagatgcgccagtccgtgctgattacgcagctcaatggtgtcgaccagctgactgacttcgctactaaactgcgcgaactgggcgatgttattttgtgcgagagtttgtaggtgattgctgatttcactgtcctgctgatacagcgccagcaaatcgctatattggctaacggtagttaacgttgttgcgacctgcgcacgaacacccggatcttcaatgcgtatttgccgacgttgcagaattttcaccgcattattgagctgcttttccagcgttggtgcatttttctggatctgctccagccccagattcatcaccatttgctgcacccgcagagcgctaaggcgcagttcattcatctggttaacatactcaagatcgatatcaatcagccgatcgagtgcactttcagcagcctgacgctgatcttgttcgatcaaatcgtaaatcccggcctgggtcgctccagcggaagttgtcgcattattcgcctgaccttgcgccaggcgtgcgatctcatcggcggcagcgactatctgctgactgagttgctgttgttgctggcgcagttgcaaacgctgccccaccagttccccttgctgacgtaacgaacgggagatctcctgctcctgttgttcaatagcggtggtatcaaaaccttgttcccgtaacgcttgcagcaacgcattaatcttcaggctttgtgcggtgagcattcgcccctgcgcctgccacatcttttcgttatcggcactggtcaggttctgcgcggcgaaaagttcccaggcgctggcttcgctcaactggcgcgccatattcatggtaggaatcaatgcctgagtgttgtctttttccacctggctgataaagcgcaggttgtaccatcccaccagggtactggtcagggttaacagcgccatcagggcaaagcccatccagagtcttcgggtcagggttaaattcacggtcggtgcactttaggtgaaaaaggttgagtcgcaaagcggaatgcatctagcataaagccttattattgatgaggctatcatgcgcgtactgctatttttacttctttcccttttcatgttgccggcattttcggctgataacctgttgcgctggcatgatgcgcagcatttcacggtgcaagcctctacgccgcttaaagccaaacgcgcatggaaactgtgcgcgctttatcccagcctgaaagattcatattggttatcgttgaactatggtatgcaggaggctgctcgccgctacggtgtggatttaaaagtgctggaggcaggcggctacagccagttggctacccagcaagcacaaatcgaccagtgtaaacagtggggcgcagaggccattttgctcggtagtagcacgacctcatttcccgacctgcaaaagcaggtagcaagtctgccggtgatcgaactggtaaatgctattgatgctccccaggtgaaaagccgcgttggtgtgccctggtttcagatgggctatcaaccggggcgatatctggtgcaatgggcgcacggtaaaccactgaatgtgctgttgatgcccggacccgataacgccgggggcagtaaggagatggtcgagggttttcgcgcagccattgccggaagcccggtgcgtattgttgatattgcgcttggtgataacgatattgaaatccagcgtaacctgttgcaggagatgctggaacgccatccagaaatcgacgtcgttgccggaacggccattgcggcagaggcggcaatgggggaagggcgtaacctgaaaacgccgcttaccgtggtgtcgttttatctttcacatcaggtgtatcgcgggctgaagcggggaagagtgattatggctgccagcgatcaaatggtctggcagggggaactggcggttgagcaggccatcaggcaattacaggggcaatcggtttctgataatgtcagcccaccgattttagttctgacgccgaaaaatgccgaccgtgaacatattcgccgctcgctgtcaccagggggatttcgtccggtctatttttatcagcacacatcagcggctaagaaataaccttcaccatgttgcgtcaccagtaaatccgcgctgagtttatgacgtaaacgacgaattaacacatcgacggtgcgcaggtcagggttttccacccgacgcgcagaaagcatacgtagcagacgttcacggctgagaatttcgcccggattcgtcacaaatgccaccaacatttcatactctgcgcgggtcagtttaatcggctcgccatcccgctccagcgtatggcgcgacacattcaggcaataaccggcaaagcgatagcagttgtcctgagtgtgcggttgagcttgtcgcgcgaggtcgattcgccagagcagatttttcacccgtactaccagttcgcgcagttccagcggtttggtgacgtaatcgtctgcgcccatttccagcccaacaatacggtcaatccgatcgctgcgtccggtaaccagaataatccccaccgttgagcgttctcgcagggcgcgggttaacatcaggccattttcatcgggtaagttgatatccagcagaattaaatctaccgactgattctgcataatttcccgtagcccagcaccgctcgccgtaacggaaacggtatacccctcctgagtgaagtaggattgtaatcgcgcctgggtaaccggctcatcttcaacaataacaatgtgatgtggcatcagagggttttactcattctgttcatatctgttcatattctgccgtaagccgttcatcctgaccagtgccgctgttcatatttgctcattaagatcgcttcactaaaccataattctacaggggttattatgcggaaactctggaacgcgctacgccgacccagtgctcgttggtcggtactggcgctggtcgcaattgggattgtgattggcattgcgctgattgtattgccacacgttgggatcaaagtcaccagcacaaccgaattttgtgtcagttgccacagtatgcaaccggtgtatgaagaatataaacagtcggtgcatttccagaacgcctccggcgtgcgagctgaatgccatgactgtcatatcccgccggatattccaggcatggtgaagcgcaaactggaagcgagcaatgatatctaccagacctttattgctcactccattgatacacctgaaaaattcgaagccaaacgcgcggaacttgccgagcgtgaatgggcgcgaatgaaagaaaacaactcggcaacctgccgctcctgccataactacgatgcgatggatcatgcgaagcagcatcctgaagcagcacgtcagatgaaggtggcagcgaaagataatcaatcctgcatcgactgtcataaaggtattgcccaccagttaccggatatgagtagcggcttccgtaagcagttcgatgagctgcgcgccagtgctaatgacagtggtgacacgctgtactctattgatattaagccaatttatgcggcgaaaggcgataaagaagcctctggttctctgctgcctgcttcggaagtgaaagtccttaaacgtgacggcgactggctgcaaattgaaattaccggctggacggaaagcgccggacgtcagcgtgtactcacccaattcccaggtaaacgcatctttgttgcctcgattcgtggtgatgtgcagcagcaggtaaaaacgctggagaaaaccaccgttgccgacaccaataccgagtggagcaagttgcaggccactgcgtggatgaagaaaggcgacatggtgaacgatatcaaaccgatctgggcttatgcggattcgttgtacaacggcacctgtaaccagtgccacggcgcaccggaaatcgcccactttgacgctaacggttggatcggcacgctcaacggcatgattggctttaccagtctcgataaacgtgaagaacgcaccttgttgaaatatctgcaaatgaatgcgtctgacaccgcaggtaaggctcacggcgataagaaggaagaaaaataatgaacaataacgatctctttcaggcatcacgtcggcgttttctggcacaactcggcggcttaaccgtcgccgggatgctggggccgtcattgttaacgccgcgacgtgcgactgcggcgcaagcggcgactgacgctgtcatctcgaaagagggcattcttaccgggtcgcactggggggctatccgcgcgacggtgaaggatggtcgctttgtggcggcaaaaccgttcgaactggataaatatccgtcgaaaatgattgccggattgccggatcacgtacacaacgcggcgcgtattcgttatccgatggtacgcgtggactggctgcgtaagcgccatctcagcgatacctcccagcgcggtgataaccgttttgtgcgcgtgagctgggatgaagccctcgacatgttctatgaagaactggaacgcgtgcagaaaactcacgggccgagtgccttgctgaccgccagtggttggcaatcgacggggatgttccataacgcttcggggatgctggcgaaagctattgccttgcatggtaatagcgttggtacgggcggagattactctaccggtgctgcgcaggtgatcctgccgcgcgtagtcggttcgatggaagtgtatgaacagcaaacctcctggccgctggtattgcagaacagcaaaaccattgtgctgtggggctccgatttgctgaaaaaccagcaagcgaactggtggtgcccggatcacgatgtttatgaatattacgcgcagctaaaagcgaaagtcgccgccggtgaaattgaggtcatcagcatcgatccggttgtcacatccacccatgagtatctggggcgcgagcatgtgaagcacattgcggttaacccgcaaactgacgtgccgctgcaactggcgctggcacatacgctgtacagtgaaaacctgtacgacaaaaacttccttgctaactactgtgtgggttttgagcagttcctgccgtatctgctgggtgagaaagacggtcagccgaaagatgccgcatgggctgaaaaactgaccggcattgatgccgaaaccattcgtgggctggcgcggcagatggcggcgaacagaacgcaaattattgctggctggtgcgtgcagcgtatgcagcacggtgaacagtgggcgtggatgattgtggttctggcggcgatgctggggcaaattggcctgccaggtggtggttttggttttggctggcactacaacggcgcaggcacgccggggcgtaaaggcgttattctgagtggtttctccggctctacgtcgattccgcctgttcacgacaacagtgactacaaaggctacagcagcactattccgattgcccgttttatcgatgcgatcctcgaaccggggaaagtgatcaactggaacggtaaatcggtaaaactgccgccgctgaaaatgtgtatttttgccggaactaacccattccatcgccatcagcagatcaaccgcattattgaaggcttgcgcaagctggaaacggttatcgccatagataaccagtggacctcaacctgccgctttgccgatatcgtactgcctgcgaccacgcagtttgagcgtaacgatctcgaccagtacggcaatcactccaaccgtggcattatcgccatgaaacaggtggtgccgccgcagttcgaggcgcgcaacgacttcgatattttccgcgagctgtgccgtcgctttaatcgcgaagaagcctttaccgaagggctggacgaaatgggctggctgaaacgcatctggcaggaaggtgtacagcaaggcaaaggacgcggcgttcatctgccagcgtttgatgacttctggaataacaaagagtacgtcgagtttgaccatccgcagatgtttgttcgccaccaggcattccgcgaagatccggatctcgaaccgctgggcacgccgagtggcctgattgagatctactcgaaaactatcgccgatatgaactacgacgattgtcaggggcatccgatgtggtttgagaaaatcgaacgctcccacggtgggcctggctcgcaaaagtatccgttgcatctgcaatctgtgcatccggatttccgacttcactcgcagttatgtgagtcggaaacgctgcgtcagcaatatacggtagcgggtaaagagccagtattcattaacccgcaggatgccagcgcgcgcggtattcgtaacggtgatgtggtacgcgtctttaacgctcgcggtcaggtgttggcaggggcagtggtttctgaccgctatgcacccggcgtggcacgaattcacgaaggggcatggtacgatccagataaaggcggcgagcctggtgcgctgtgcaaatacggtaaccccaacgtgttgaccatcgacatcggtacatcgcagctggcgcaggcgaccagtgcgcacactacgctggtggaaattgagaagtacaacggaacagtggagcaggtgacggcgtttaacggccccgtggagatggtggcgcagtgcgaatatgttcccgcgtcgcaggtgaaatcatgaccacgctgacagcacaacagattgcctgtgtttacgcctggctagcgcagttgttctcccgtgagctggacgatgaacaactgacgcaaatcgccagtgcgcagatggctgaatggttttcgttgctgaaaagcgaaccgccgctcactgcggcggtgaacgagctggaaaaccgtattgccacgctgacagtacgtgacgatgcccgtctggaactggccgcggacttttgcggcctgtttctgatgaccgacaaacaagcggcgctgccgtatgcatcggcctacaaacaggacgagcaagagattaaacgcttgttagttgaggcagggatggaaaccagcggcaatttcaacgaaccggcagatcatctggcgatctatctcgaattgctcagccatctgcatttttcgctgggagaggggaccgttcctgcgcgaagaatcgacagtttgcggcaaaaaacactgacggcgctgtggcaatggttaccagagtttgttgcgcgttgtcgtcagtatgacagctttggtttttacgcggcactaagccagttattgctggtgttagtggagtgcgaccaccaaaacagataacgtcgtttgtgcgcctgaaaagacgcgtttagcgtcgcatcaggcattatggcgcagttgccggatgcggcgtgaacgtcttatccggcccacaggaactgtaatctttgtagaccggttaagatgcgtcatcgcatccggcaaacacacatcacggatgagctacaaaccgggaaagccgctggcgcagcaggcggttttcctgcttcaggtgcgcaatatcatccattaacgtcagcgccaccgcgatccccggccagtccagagccagttcatgacgcaggcgtaccgcgcgttgcaccacaatggcggcatggtcgtcaaatacccaggttgtttcctggatctcacgcggttcaaccacccccaaaccgacaatttcattcaactcctcttcagagatgccggtatgcaggcaaaattcggtaatagtaaaagtcaccgtaacattagccattatgctttcccccaatctttacgtggatcaaaagacgactgggcgtctgccagttgctgccacagcgcggcagtgttttcatccggtttcggcggcatcacgattttcagtaccgcatacagatcgccggtctgttttttgctcaccagacctttgcctttaacgcgcaatcgttgcccggcctggctgcctggcgggatagtcagcaaaatgctttctttcagtgttggaacggtgactttagcacccagcgccgcttcccacgggctaaccggcaccacaatttccagatcctggccgacaatatcaaacagcggatgtggcgcaatatgaatcaccagccacaaatcgccatttggaccgccgttttcgcccggcgtcccctggcctttcagacggatgcgttgaccattgccgacgcccgccgggatcttcacattcagcgttttcggaatttcctgttcgatcatgccaaaggcgttataaaccggcaggttatagctgatggtacgcttatgctcagtaagcgtttcttcgaggaataccgccacttcgatttcaatatcgtggccgcgtgtggcggggcgttgacggctctggcgggcatgctgaccgaaaattgacgagaagatatcgtcaaaatcttcggcgttaaaactctgaccgtcgccatggtggaactgacggttaaattgcggatcgttgcgatgttgccacatctgatcatactcagcgcgacgttgttcatcacttaacacttcccaggcttcagcgacctctttgaagcgggcttcggcatccggttctttgctgacatcaggatggtatttgcgggcaagtcgacgataggcggtcttgattgtcttgagatcgtccgtcggtttcacgcccatgatggcgtaataatcctttaattccatagcgttatctcgcgtaaatcaacacaaattgaaggaacccctgtaaggtaactcctataagtgtagggtaatcctcaaaatttcatatgccaacacagaatatgttattgaaatcatcgcggagaggaggtcgccatcaagatgggttgctgaacatattttaaacaggtgaaaaagggtgagcgatttttgatagttgaaccaggcactttaagtttaactagggcgtcattatttattaaattttatagacgctatatatgggtagtaatatacatggaattagttgcactgcaaataattatttgaaacaggcctggaacgatataaaaaatgagtacgaaaaaaatcaaacatattcaatcacgctttttgaaaacacactggtgtgttttatgcggttatacaatgaactcagacgtaaagtaaatgaagaggatactccatgtctggaatgtgaatcactagaaaaagaatttgaggaaatgcagaatgataatgatctatcattatttatgagaatattgcgtactaatgatacacaaatttattcaggggtttcaggaggtattacatatactatacaatatgttcgagatattgatattgttagagtgtccttgccgggcagagcttcagagtctatcacagattttaaaggttattattggtataactttatggagtatattgaaaacattaatgcgtgtgatgatgttttttctgagtattgttttgatgatgaaaatataagtgtccagccagagcggataaatacgccgggaatatctgatttggattctgacattgatttgtctggtatatcttttattcagcgtgaaactaaccaggcattaggattaaaatatgctcctgtagatggcgatggatattgtctgttaagagctatactggttttaaaacaacatgattattcatgggcgctggtcagttataagatgcaaaaggaagtttacaacgaattcattaaaatggttgataaaaaaacgatcgaggctcttgttgatacggcattctataatctcagggaagatgtaaagacgttatttggcgttgatctacaatctgacaaccaaattcaggggcagagtagtcttatgtcatggagctttctgttttttaaaaaacaattcattgatagttgcttgaataacgaaaaatgtatcctgcatttacccgagtttatatttaatgataacaagaacttgcttgctttagataccgacacgtcggataggattaaagcggtgaagaattttcttgttgttctttcagatagcatttgctcattatttattgttaatagtaatgtggcatcaatctccttggggaatgaatccttttcaacagatgaagatcttgagtatggttatttaatgaacactggcaatcattatgacgtttacctccctcctgaactttttgctcaggcttacaagttaaacaataaggaaatgaatgcgcaactcgactatttaaatcgttatgcaatttaatggcaaaggcatatgctaaaaaccattgttattagtctcacacttttttattggtaaatattgtctctgtattggtaacgccgcagatattctgtttagccacaggtgcaattatcagcggcgtacgcgaggcaggggctaatcaggcatagtttgcgtcaaaccttgcctgtttttgaagatgtatatagaaaaacaggcgttcaacaagccattttgcgaacctgttcccggaaaaaagtcatatttctgtcacactctttagtgattgataacaaaagaggtgccaggaatgaacaaaacgctaatcgccgcagctgtggcagggatagttttactcgcttcaaacgctcaggcacaaaccgtaccggaaggctatcagctacagcaagtgctcatgatgagccgccataacttacgtgcgccgctggcgaacaatggcagtgtgctggagcagtcgacgccgaataaatggccagaatgggacgtccccggtgggcaactcaccaccaaaggtggcgtgctcgaagtgtatatgggccattacatgcgtgaatggctggcagagcaggggatggtgaaatcgggggaatgcccgccgccgtacaccgtttatgcctatgccaatagtctgcaacgtaccgttgcgaccgcacagttctttattaccggcgcattcccggggtgtgatattcctgtgcatcaccaggaaaaaatgggcactatggacccaacctttaacccggtgatcaccgatgattccgccgcattcagtgaacaggcggtggcggcaatggagaaagagctcagcaaactccagcttaccgacagctaccagctactggaaaaaatcgttaactataaagattcccctgcctgtaaagagaaacaacagtgttcgctggtggatggcaaaaatacctttagcgccaagtatcaacaagaaccaggtgtttccgggccgctgaaagtcggcaactcgctggtagatgcgtttactttgcaatattacgaaggttttccgatggatcaggtggcctggggagaaatcaaatctgaccagcagtggaaggtgttgtcgaagcttaaaaacggctaccaggacagcctgtttacctcaccggaagtggcgcgcaatgttgcgaaaccgctggtcagttatatcgacaaagctctggtcaccgatcgcaccagcgcaccgaaaattacagtgttggttgggcacgactccaacattgcctctctgttaacggcgctggatttcaaaccgtatcagttgcatgaccagaacgaacgcacgccgattggcggcaaaatcgttttccagcgttggcatgacagcaaagccaatcgcgatttgatgaaaattgaatatgtgtatcagagtgcggaacagttacgtaatgccgatgcgttaaccctgcaggcacctgcgcagcgtgtgacgctggaattaagcggttgcccgatagacgctgatggtttctgcccgatggataagtttgatagcgtgttgaatgaagcggtgaaataacagaaaactcccccgcgagaagcgggggagtcgctggttaaacgtttttacgttcgatggtctgttcgccccaaaaaagcgaatctttatcggtcttagcaaaggctttgactaacacttcatcactaccttcttcccaaatcttttccgccattttttcgtcgtacccggcgacttcgaaaatggcctcggctatttccggcgacgtattgcgcagagatgcccattcaccgacgtgatgagctttcgcttcttgagttggcatgcgtatcctcctgttgaagattagccgttaagtttaactgccagacctgcgacatattccccttgataacgagcaatagacagttcttcctggctgggctggcgtgaaccgtcaccgcctgcgatggtggttgcgccgtacggcgtaccgccgcgaacctgtgaaacgtcaaataattcctgcgctgcgtagccaatagggacaattaccatgccgtgatgcgcaagggtcgtccaggtggatgtgatggtttgttcctgaccgccgccagtaccggtggaactaaagacgctcgccagttttccgtatagtgcgccggaagcccacaggccgcccgtctggtcgaggaaggtacgcatttgaccggacatgttgccaaagcgggtaggtgtaccaaaaataatggcgtcgtaatcggccagttcttgcggggttgcaaccggtgcagtttgcgttttaccgcctgctttttcaaataattgcggcggcatggtttccggtacacgcttaacgacaacttcagcgccatccactttgcttgcaccctcagcgactgcgcgtgccatcgtttcaatatgtccgtacatggaataataaagcaccagaactttagccatttctaaccactcctcgtgttatctctattccgtagcgattcgctaccacttatttaaagataagacgtccttttcagagtgcaaatttcacaaccacttatttgatttataacaactttcacaagcacgtaattttgtcgcaaaatgacacatttttatctcatcgcgtttttttaatcataagagcggcttatggataattattggagatgatatctattctcgctaagaagctgttgcaggatattaccaaacgcgggtctgcccgcgtcagttcactaagcttagtcccacgtagcgaaaatatggcagccgccatacgccgcgttaattctatgcaatatgatgtctatacccagacggaggtcagtaatggcaaaccatcgaggcggttccggcaattttgcagaagaccgcgaaagagcatcagaagcaggtaaaaaaggtggacagcacagcgggggtaatttcaagaatgacccgcagcgcgcatctgaagcaggtaaaaaaggtggtaagagcagtcacggcaaaagcgacaactagccgggctaatcaatgacgaatgcatttttgtctgtagctcgtcaaaaagccatcaccgccggttacccggtggttgatactgatgacaaatgtaagcttgcctgatgcgcgatgcttatcaggcctaccagaagattgcaatatattgaatttgcactgttttgtaggccggataaggcgtttacgccgcatccggcatgaacaatgcgtacgttgtcaacaatctgcaccgccggtaaccccggcggttttctgtttatggctcctgatgaacaacttctggcggtggaacgtcaaccaactttctgcttaacaacgcattgagtaaaatcgcgccaaaggttgctgtaccaatccctcccaacgtaaaaccgcccagcgtgagagcaaaatcacccgcgcccagcactaaggttactgcgaccataatcaaattaccgttctggcttaaatcgacacggttttgtacccatatccttgcgcctgcgacggcaatcagcccgaacacaacaattgatgcaccaccaataaccgcggccggaatggtatgaatcagcgcaccaaatttcggtgaaaagcccaacagcatggcgatgacggcagcagcaacaaacaccagcgtcgagtagactttggtcacggccatcacaccgatattttcagcataggtggtcacgccgctaccgccgacagagccggaaagcatcgttgccagaccatcgcctacgaatgcccgccccatatacgggtccatattgcgtccggtcatcccggcgactgccttgagatgacctaagttttccgccaccagaatcaccgccacgggcgcaatcagcatcattgcctgaccattaaaagcaggagtggaaaaatgtggcagaccgaaccaggcagcatggctgacgagagtaaaatcgacggcttttcccagccctaaaacgttggtcatcacgccatacagcagacaggcgacaattaatcctacgagaatcaataaccgctggatcatgccacgggtaaacaccgccaccagcccaatacacagcaccgtcattaccgccatccagctatcaaaggccgaagccgatacacttttcactgcgataggcgctaagttcaggccaatcgccatcaccaccgcacccgtcaccaccggcggcatcagtcgttcaatccagcgcgtaccgattttcatcaccaccaggccaatgacggtataaaccagcccacaggcgataatcccgcccagcgcaatgctgatattcgggttaatgccctgaccgttaaagcccgtcgcggcgatcaccacgccgacaaaagccgcgctggagccgagataactggggacgcgcccgccggtaataaagaaaaacagtaacgtgccgatccccgacattaaaatggaaagattgggatccagccccatcagaatcggcattaacaccgtcgcgccaaacatcgccaccgcgtgttgaacgcccattactgccgtctgagcaaacggcaatcgttcatccggcgcgaccacgccgctctctgtagaggtcgattttaactgccagtgaggaaaaccgaacattgccatcagctgtctccttaaggaggttaacaagcagggcgcatcagcgcgtgataactgcgatcgaaccacaccagcccgtagggtgtggtgtgacgatgaatcgcttcgatggcgcaaaacagaatgtcgtgggtgccgacgctcaccacctggctgatacggcagtcaaacgaaaccagagcctcttccagttgcgggcatccggtcacccccgtctgccagcgggcggcggcaaagcggtgttccatgggcgttttgccgccaaaaaggtttgaaagcggctcctgcccggcgctaagtgtatttacacacagcgttcgattttcattgaatgccggccagacggacgccccacgattcaggcacaccagtaatgtgggcggcgtatcggtcacactgcagacggcgctggcggtgaacccggcgcgcccggctggaccgtccgtggtgataatattgaccgccgcgcccatgcaggacatcgcatcgcgaaaagtttgttgatcgacaatgttcatagtttgctccttacaacagcccgcaggcttcttcaaaggacagacgtggcaggcgcgcataaagcttgctgctatcgccatagccgatattaatcagcagattgctcttcagcgtgctgcccgtaaaaaaggcgtcgtccacgtgttgacggtcaaagcccgacatcgggccggtatccagtcccagcgcccggcaggcgacgatcagataggccgcctgcatggaactgttgcgaaacgctgtttcttcggcaagttgtgggctggaggtaaaccaactgcgggcatcaccgtggggaaacagtagtggtaaccgttcataaaattcactgtcccaggcgacgatagcggtgacgggcgcggtcagggttttttgcagattgccgctggaaagtgccgggcgcagacgttcttttccttctgccgtgcgggtaaacacgatccgtgccggagaacagttagctgatgtcggcccccatttcatcagggcataaatctcccgtaacgtctcatcgctgacgggtgtctcccgccagccgttgtgagtgcgggcatcggtgaacagggtgctaagcgcacctgggctaacggcttcgttcatagcaattccttacagggcggcttcacggtgatgtaacaggctggcaagcccgttgagtaacagagcattaaacgtttcgggatcggtcacgttgcaggcgtgtccgccatagggcatcaccattttctggctatcgggcagggcggcatgaagttcactggaacatgctgttggcaccagcagatcatcactggcgcagatgatttgcaccgggcagcggatgcgatccgcatggtgactaaagtcagcgcgtttgagggcgttaagtcgacgcagtaaattatttttgccctgaaaatgcgccagtgccagcgcgtcttctgcctccaggcgaggtgcgcgggccgccatccagtcggcgggatagaggaacaacggctgcgcttccacccatgcctgcgcgccgccgctatacagtaatcgttcgcgaacctgaaaacagcggcgcgtatgggcgtttattcgtagccagccgttaacgctgatcagcacagttaccgacgcgggataatccagcgccagctgcattcccaccagcgcaccgagcgcatggccgaccactgcgtaatgctcaatccctgcggctaccagcgcctgatgcagttccgctgccatctgggcgatactgtaatcttctgccagcgtgtcgggattattgccggtgccgcgctggtcgtaacagactacctgatactcctgctccagcaccgccagttgcggtaaccagtaactgccgctacccccaagacccgaaatcaacaccactacgggcgcatcagcataagggggaggtgagagtgaaagtttcatcgcggcctcacttggcgatatgcgcaattgtggcgatttccaccagcgcgtcaggttttaccagtccgcactgaatgcagaatcgcgccggtttatcacccggaaaaaactcggcgtagatttcgttaatcgcggcgtaatttttccagtcggtaataaagatgctgttgaaggtcacatccgccatcgtgccacccgccgtctcgatcaccttgcggatagtttccagaacgtggcgggtttgcgcctttgggtcatcggcaaacagcacgttattatgttgatcaaaagccagcgtaccggagacatacaccacgccatcagccagcgtgccgggaacgaagggggccagcggtgcgctgctgccagcgggaataattacggattttggcatcgttaaactccttaagcgatatgagcaaaggacgtgggagaaagcgcgtcgcagaatgtttcgacgtcgctgacccagccaaaaaaggtttcgatattgaacaacgcggctttctgcgcaaatttcggccccgcctggtgagttgcgtcttcaagcaccacgccgaaatactccagaaaaaagccgtcgcgtagcgtcgattcgacgcagacgttggtagcgatgccggtgaaaaccagatggcgtattccgcggctgcgcaaaatgctgtccagcggcgtattgaagaaaccgctgtagcgcggcttcggcagcacaatatcgccaggctgcggcaccagttcatccaccagttgataatcccaggagcctttcgccagcaatttcccctgcagctgcggctgcttacgcatggttttcagggcgttcgatttatgaaaattcggtgagccgggtccgccagcctcgacatactgttcatcccagccattttgaaaccagatgatcagcatccctgccgctcgcgctgcggtcacggcggtttgaatgttggcaatgaccgggcgagtggttgagacatcaaacccggcgagatctaagtagccgcctggcgtggcataagcgttttgcatatccaccacgatcagcgcactttgctgcggatcgaaggtaatggcttccggtcgagcggttaaggtcgtcatcatgccacctcctgagtcagcgcaggtagatgggcgcggcattgcatcagtggttgaatgcgctcgccgaaggtttcgattcccgacagaaaatcgtcgaaggttaacagcacgccttcggcaccaggcacgcttgcgacttcatctaacatgcgcgcgacactggcgtaagaaccgactaacgtccccatattgatgtttaccgccgaagtgggatcggccatctgacgaacgttggtgtcagtaccggagcgggtatctttctgactttgttcggttagccagcttaacgcctcttcatccgcgcccgctttgtagtgttcccatttggcgcgagcggcatcgtcggtttcatcggcaatcaccataaacaacacataagagccaacgtcgcgtccggtttgctctgcggcctgtttcatccgcgcagcggtcggggcgaaagccgtgggtgtatttacgcctttgccgaaacagaagttgaaatcggcataccgggcggagaacgccatgccagcgtcgctttgcccggcgcagatcactttcatggggacactcggttgcggactcacgcgacaatcattcatggtgaaaaaatcgcctttaaaatcgcttttccccgtgccccacaggtcgcgcagcacctgaacatattcggtgagatagtcgtaacgacgggagaaatagtcatcgccaggccagatacccatctgctcatactcgggcttttgccagccagtcacgaggttgacgccaaaacgcccgccagagatggagtcgatggttgcggccatacgggcgacgattgccggaggtaacgttaaggtggcagcagtggcgtaaatctgaatgcgcgaggtcacggccgccagccccgccatcaaggtgaacgactcaaggttgtgatcccagaactcagttttgccgccaaagccacgcagtttgatcatcgacagggcgaaatcgaaatggtagtgctccgctttttgcacaatggctttattcagttcaaaggtcggcatgtactgcggcgcgtgggtcgaaatgagccagccgttgttgccaataggtacgaatacgccaattttcatcatcaacctctcttcgtctcgtaaagtgaaagtcagacggggcgctgcatcctgcatatccttttcagccgcgtattggcttgtttgcaaagcggatgccagtttttaaaaagttaatgttattaatctgttaacattacgttatctaaaatatctggtaaaaagtggactaaacggtcaaaacagttgcacataaaacatgcatctgtgcgcgatgagagtgcagaaggtcgaggccgggcgggggttttgctatcctgttgccaatctacaagaggggagagcgcatgacgcaaggcgcagtgaaaacaacgggtaaacgttcgcgcgcagtaagcgcgaagaaaaaagcgattcttagcgcagcactggacactttttcacaattcggttttcacggcacaaggctggagcagatcgcagagttggcgggtgtttcaaaaaccaatctgctgtattactttccgtcaaaagaggcgctgtatattgccgtgctgcggcagattctcgatatctggctggcaccgttaaaagcgtttcgtgaagatttcgccccgctggcggcgatcaaagagtacatccgtctgaagctggaagtctcacgcgattatccgcaggcttcgcgcctgttctgtatggagatgctggcaggcgcgccgctgttaatggatgaactgacgggcgatttgaaggcattaattgatgagaaatcggcgctgattgccggttgggtcaaaagcggcaaactcgcgccgattgatccgcagcatttgatttttatgatttgggcttccactcaacattacgccgatttcgcccctcaggtggaggcggtgacaggcgcgacgttgcgcgatgaggtatttttcaatcaaacggttgaaaacgtgcagcggattattattgaggggattcgaccacgttaaagatgccggaggaggttgtaacatcctccggctacctgtttaacctatagtcattaagctggcgttaccgccagcggcagcggtattcacactcagcgaacgctcgatatacagccgttccagaaggatattgctttcgccacgggcaaaaccctgcaccgaaacaattgtgccatcccgcgcggcaactgcttcacacaatgcgcgaagctgatccgaatcaccgtggaagatcaccgcatcaaacggttgagcggttatattttccgctttcgccagttgaatacgttcgctgactgccgatggcaatgccttcactaactgacgatgcagcgcgtcatccggccacagtacctggctgcccaccgccagcacggcggcgagctgagtcagcgcatcctgctcatcatcggcaatacacaacacgcgctcacgcggcagcagcgtccaggtgttgcgttcacccgtcggccccggcagcaatcgttgtgttcctgcctgcgccagctcgccatattgcgtacataacgcctgcaattctggacgatttgctgcccattcccgcagtgcatttagcggctgagtcaatgcggctttcaactgcgcatcgaccggatactttgcatcctgacgcgcgagcgtcactgccagcgcactttccgggcgattcgccagcagacggtagagatagagcggaccgcctgctttcggcccggtaccggacaacccttcgccgccgaacggctgcacaccaaccactgcgcccaccatattacggttaacatacaggttaccaacatgggccgagccagtgacctgggcgatggtttcatcaatgcgcgtatggacgccaagcgtcagaccataaccggaagcgttaatctgctcgatcagctctggtagctggttacggttgtaacgcaccacatgcagcaccggaccaaagacctctttttgcaattcggcaaagtcatccagttcgatcagcgtcggggcgacaaaggtgccgctttgccattcacgggcatcttcgctgttttcccgcaccgcctggaacaccggacggcctttgctacgcatggtctgaatatggcgctcaatattggctttcgcttcgctatcaatcactggaccgatatcggtggtcaggcgacccggattacccatccggcattcggccattgcgccgcgcagcattttcaacgtgtggtcggcaatctcatcttgcaggcacagcacgcgcagcgccgaacaacgctgacccgcactgtcgaacgccgaggccagtacatccacgacgacctgttcggtcagtgctgaagaatcgacaatcatcgcgttcatgccgccggtttcagcgatgagcggaatagggcgaccctgagcgtccaggcggctggcgatattgcgctgcagtaacgtagcgacttcggttgaaccggtaaacatcaccccgcgcacgcgatcatcacccgtcagttgcgcgcccacggtttcaccccgacctggcagcaattgcaccacgcctggcggtacacccgcttccagcaaaatggcgatcccttgcgcggcaatcagcggcgtttgttctgccggttttgccagcacgctgttacctgccgccagtgcggcggcgatctgcccggtgaaaatagccagcgggaagttccacggactgatacacaccacaggccctaatggacggtgggtttcgttagcgaaatcatcccgcacctgtccggcgtagtagtggagaaaatcgaccgcttcgcgcacttcggcaatggcgttactgaaggtttttccggcctcacgcaccagaataccaatcagttgctgcatctggctttccatcagcacggcagcgcggtgcaaaatcgctgcgcgttcagccggaggcgtggcaaaccagattggcgcgttattaaccgcactttccagcgcctgttctacttcacgcggcgtggcttcacgcacatagcccacaatatctttcggttccgcagggttaataacgggcgacatctcacctgccgctaccggttgttccagcattggcaaggcctgccatttttgcagtgcactattgagcagggcagaggagagcgaggccaggcggtgttcgttagcgagatccagccctgccgagttgtcgcgcccgtgaccgtaaagatcgcgcggcaggggaattttcggatgcggtaatccagtttgcccttcctgttgcgccagtttttctacagcagtgaccggatcggcgaccagttcatccagtggcaaagaggtgtcggcaatacggttaacaaacgaggtgttagcaccgttttccagcaggcgacgcaccagatacgccaacagcgtttcatgtgtgccaaccggagcataaatacgacacggacggttaagtttgccgtcggcaactttcccggtgacctgctcatacagtggctcgcccataccatgcaggcactggaactcgtactgacccgggtagtagttctgccccgccagttgataaatcgccgccagcgtatgggcgttgtgcgtcgcgaactgcgggtagattagattcggcaccgccagcagctttttcgcacaggcgagataagaaacgtcggtatacaccttgcgggtataaaccggataaccttcaaggccgtccatctgcgcacgcttaatttcactatcccagtacgcgcctttcaccaggcgaatcatcagacggcgacggctgcgggtggcgagatcaatcaggtaatcgatcaccaacgggcagcgtttttgataagcctgaataacaaaaccgatgccgttccagcctgccagttccggctcgaaacagagtttttccagcagatcgagggagatctccaggcgatcggactcttcggcgtcaatgttgataccaatatcgtactgacgcgccagcagggtgagtgatttcagacgcgggtaaagctcttccattacccggtcatactgggcgcggctataacgcggatgcagcgccgacagtttgattgaaatgcccggcccttcatagatgccacgaccgttagacgctttaccgatggcgtgaatcgcctgctgataggaaaccatatacgcctgtgcatctgcggcggtcagcgcggcttcgcccagcatatcgtaagagtaacggaaacctttctcttccagcttgcgggcattggctaacgcttccgcgatggtttcgccagtgacgaactgctcacccatcaggcgcatcgccatatccacacctttgcggatcagcggttcaccgcttttaccgataatgcggttcagcgagcgggagaggctggcttcgttatgggtggaaaccagtttgccagtaaacagcagcccccaggtggcggcattaacaaacagtgacgggctacgaccaatgtgtgactgccagttaccgttgctgattttgtcgcgaattaacgcgtcgcgggtggctttgtcgggaatacgcaacaacgcttccgccagacacatcagcgccacgccttcctgcgatgacagcgaaaactcctgcaataacccctggaccatacctgcgcgaccactggcatttttttgattacgcagtttatcggccagctgatacgccagtttgtgcgcctgttcagcaactggctgcggcaggcgggcttgttccagcagcatagaaaccgcttcggtttccgggcggcgataggccgcggtgatcgcggcgcgggaaaccgactggggcaatatttgctcggcaaagtcgaggaatggctggtgtggttcctctgccggagtcggtgcttcatcgctctcattggccgcgccagaaagcagcgcaggtagctccggcagagtatcgctgttttccagttgttcgagataagaaaaaatcgcctgcttaattaaccagtgtggtgtgcgatcgatacgtgtcgcggcagacttaatacgctcacgcgtcgcgtcgtccagcttaacccccatggtggtggttcccatgccattactcctgttgttcagaaaggtgcaacttaacgttatcgtgaaatatccatgatgttgcaactttgtgcaaccatgttaaatgtgacatgcgtagcaagcttaaaaatgaatgaaatgttaataaaagaaatcgatatgacagggattaaaaaaataactcagactttttctctgcggcagttaacatttttgaaaggtgcaaccgcaaaaaatgtgagagagtgcaacctgatgaaaaatagtgtcgctgagcactaaaatttaatgtaaatggtgtgttaaatcgattgtgaataaccagcgcttccggcaggatacggtcgccctggtaaaacataaactctgttaccccgttccggtggcagatataacggcaagtttcgacattgccgataataattttttggagactttagatggctattagcacaccgatgttggtgacattttgtgtctatatctttggcatgatattgattgggtttatcgcctggcgatcaacgaaaaactttgacgactatattctgggcggtcgtagtcttgggccattcgtgacggcattatcggcgggtgcgtcggatatgagcggctggctgttaatggggttgccgggcgctgtttttctttccgggatttccgaaagctggatcgccattggcctgacattaggcgcgtggattaactggaagctggtggccgggcggttgcgtgtgcataccgaatacaacaataacgccttaacactgccggattatttcaccgggcgctttgaagataaaagccgcattttgcgcattatctctgcgctggttattttgctgttcttcaccatttattgcgcttcgggcattgtggcaggcgcgcgtctgtttgaaagtacctttggcatgagctacgaaacggctctgtgggcgggcgctgcggcgacgatcctttacacctttattggcggtttcctcgcggtgagctggactgacactgtacaggccagcctgatgatttttgccctgatcctgacgccggttatcgtcattatcagtgtcggtggctttggtgactcgctggaagtgatcaaacaaaagagcatcgaaaacgttgatatgctcaaaggtctgaactttgttgccattatctcactgatgggttgggggctgggttacttcgggcagccgcacattctggcgcgttttatggcggcggattctcaccacagcattgtccatgcgcgtcgtattagtatgacctggatgatcctctgcctggcaggggcggtggctgtcggcttctttgggattgcttactttaacgatcatccggcgttggctggtgcggtaaatcagaacgccgagcgtgtgtttatcgaactggcgcaaattctgtttaacccgtggattgccgggattctgctgtcggcaattctggcggcggtaatgtcaaccttaagttgccagctgctggtgtgctccagtgcgattaccgaagatttgtacaaagcgtttctgcgtaaacatgccagccagaaagagctggtgtgggtagggcgtgtgatggtgctggtggtggcgctggtggcgattgcgctggcggcaaacccggaaaaccgcgtgctgggcttagtgagctacgcgtgggcaggctttggcgcggcgtttggtccagtggtgctgttctcggtgatgtggtcacgcatgacgcgtaacggtgcgctggcggggatgatcatcggtgcgctgacggttatcgtctggaaacagttcggctggctgggactgtacgaaattattccgggctttatcttcggcagtattgggattgtagtgtttagtttgctgggtaaagcgccgtcagcggcgatgcaaaaacgctttgccgaggccgatgcgcactatcattcggctccgccgtcacggttgcaggaaagctaagggacttagcctgcggcggttttgtttggcttcagcagcgggttgcgctcccttaatgtgcctcgccatataaattgaatggtgcagggagcgcgcagggggcggccaatcgccgccgccccctgctgtcccggccttcggggaacgcttcagcgattttgacgccaccaacacccgagctgttattatgttccgggcaaaaagttagatttgataatcgcggatggacgaaattgcttgatacacccgcttatcagttttacatggaagctctgatgcattgagtctggacagttttgtcggctggatacggcgtttacgcggcatccggcaagaacacatggttctttgcaaacaatcccatctttctaccctggaataatcgtttatatcccttggcattacctctctttgtttacattccaacatcattttataaacattccgcttgtgtttttctttgccgtaatgataatcgctatcactgcgatttacttttctttgcatagattgactcagaaaaacgtttaagggtgggtggcatgtttgttccgtttctcattatgttgcgcgaaggacttgaagccgcgctgattgtcagtttgattgccagctatcttaagcgtacccagcgaggccgatggattgtgtgatgtggattggcgtgttgcttgccgctgcgttgtgcctgggcttgggtatcttcattaacgaaaccaccggcgaatttccgcaaaaagaacaggaactgtttgaaggtatcgtggcggtgatcgccgtggtgatccttacctggatggttttctggatgcgcaaagtgtcgcgcaacgtcaaagtgcaactggaacaggcagtcgatagcgcattgcagcgtggaaatcatcatggctgggcgctggtgatgatggtcttttttgccgttgcaagggaagggctggagtcggtctttttcctgctggcggcatttcaacaagatgtcgggatctggccgccgctgggtgcaatgctcggtcttgctactgccgtggtgctaggcttcctgctctactggggcggtattcgcctcaatcttggtgcattttttaaatggaccagcctgtttattctcttcgtcgccgcagggctggcagctggtgccattcgcgcatttcatgaagccggattgtggaaccactttcaggaaatcgccttcgatatgagtgcggtgctctcaactcactcgctgtttggcacgctgatggaagggatttttggctatcaggaagcgccgagcgtcagcgaagtcgccgtctggtttatttatctcatcccggcgctggtggcatttgctctgccaccacgcgcaggggcgacagcgtctcgctccgcgtaacaaatacgacgcaaactcttgcttagttacaacatactttaaagggatagtctcgtcatgaccattaacttccgccgtaacgcattgcagttgagcgtggctgcgctgttttcttctgcttttatggctaacgccgctgatgtgccgcaggtcaaagtgaccgtgacggataagcagtgcgaaccgatgaccattacggttaacgccgggaaaacacagttcattattcagaaccacagccagaaggcgctggagtgggagatcctcaaaggcgtgatggtggtggaagagcgggaaaatatcgcccctggctttagccagaaaatgacggcgaatttacagcctggcgaatacgatatgacctgcggtctgctgactaacccgaaagggaagttgatcgtcaaaggtgaggcaacggcggatgcggcgcaaagtgatgcgctgttaagtcttggtggtgcaattactgcatataaagcgtatgtcatggcggaaaccacgcagctggtgaccgacaccaaagcctttaccgacgcgattaaagcaggcgatatcgaaaaagcgaaagcactgtatgcaccgacgcgccagcactatgagcgtattgaaccgattgctgaactgttctccgatctggatggcagcattgacgcccgtgaagatgattacgagcaaaaagccgccgacccaaaattcactggtttccaccgtctggaaaaagcattgtttggcgacaacaccaccaaagggatggatcagtacgctgagcagctttataccgatgtggtcgatttgcaaaaacgcatcagtgaactggctttcccaccttcaaaagtggtcggcggcgcagccggactgattgaggaagtggcagccagcaaaattagcggtgaagaagatcgctacagccacaccgatctgtgggatttccaggctaacgttgaaggctcgcagaaaattgtcgatttgctgcgtccacaactgcaaaaagccaacccggaactgctggcaaaagtcgatgccaactttaaaaaggtcgataccattctggcgaaataccgtactaaagacggttttgaaacctacgacaaattgaccgatgccgaccggaatgcactgaaaggaccgattactgcgctggcggaagatctggcgcaacttcgcggtgtgctgggactggattaagcgttatgcagtataaagatgaaaacggcgtgaatgaaccgtcacgccgacgtttactgaaagtgataggtgcactggcgctggcgggaagttgtccggtcgctcatgcacaaaaaacgcaaagtgcgccgggtacgctttcaccggatgctcgcaatgagaaacagccgttttatggtgagcatcaggcagggatcctgacgccacaacaggccgcaatgatgctggtggcgtttgatgtgcttgccagcgataaagccgatcttgagcggttgtttcgcttgttgactcagcgttttgcttttctgactcagggcggagcagcaccagaaacgccaaatccgcgcctgccaccactcgattccggcattcttggcggctacattgcgcccgataatctcaccatcacgttatcggtgggtcactcattgtttgatgagcgctttggccttgcgccacagatgccaaaaaagctgcagaagatgacgcgtttccccaacgactcgctggatgcggcgttatgtcatggtgatgtgttgctacagatttgcgccaacacccaggacacggttatccatgcgctgcgcgatatcatcaaacacacgccggatttgctcagtgtgcgctggaagcgggaagggtttatttccgatcacgcggcgcgtagtaaaggcaaagagacgccgattaatttgctgggtttcaaagacggcactgccaatcccgatagccagaatgataagttgatgcaaaaagtggtgtgggtaacggcagatcagcaggagcctgcgtggacaatcggtggcagctatcaggcagtacgcttgattcagtttcgagtggaattttgggacagaacgccgctgaaagaacagcagacgatttttggccgtgataagcaaaccggtgcgccgctgggaatgcagcatgagcatgatgtgcctgattacgccagcgacccggaagggaaggtgatcgcgctggacagccatatccggctggcgaatccccgcacggcggagagtgagtccagcctgatgctgcgtcgtggctacagttattcactgggcgtcaccaactccgggcaactggatatggggttgctgtttgtctgctaccaacacgatctggaaaaaggcttcctgacagtacaaaaaaggctcaatggcgaagcgctggaggaatacgttaaacctatcggcggcggttatttttttgcgctgccgggggtgaaggacgcgaacgattatttcggaagcgcgttattgcgggtttaatgtttttaggcggataaggcatttgtgcgcagatgcctgatgcgacgcttgcgcgtcttatcatgcctacaatcagtgcgggtttggtaggctggataaggcgttcacgccgcatccggcgatcgtgcactgatgcctgatgcaaatcctgctgaaagcacacagcttttttcatcactgtcatcactctgtcatctttccagtagaaactaatgtcactgaaatggtgttttatagttaaatataagtaaatatattgttgcaataaatgcgagatctgttgtacttattaagtagcagcggaagttcccggcagtgatagtcagtcactatggagatcgcggatggtaacgtcctgtactggacatgttttagataatcaacgcgccaccactcgcggagttttctcctccggtagtcatctcgtcactttgcattttcaacctcatcctttcttttcatgtgttaccgacgccgtaaacggtgcgcgtagccgtttttcggcattttatccaaaagcaaactatggcttacaaggaagccaaccctctgatgttcgtgcgcataatcgcgctgccaacggcgcgtgtgatgaatacaaacaactcaaggtgctctccatgggaagacaaaaagcagtgatcaaagctcgtcgcgaggcaaaacgtgtgctgagacgggattcgcgcagccataagcagcgtgaagaagaatcggtcacctcgcttgtgcagatgggcggcgtagaagccattggtatggcccgcgacagtcgcgatacttcgcccatcctcgcgcgaaatgaagcgcaattgcactatctgaaggctattgagagtaagcagctgatattcgccacgggcgaagccgggtgcggaaaaacctggatcagcgcagcaaaagcggcagaggccctgatacataaggatgtcgacaggattatcgtcacccgtccagttctgcaagccgatgaagatcttggcttcttacctggagatatcgcagaaaagtttgctccctattttcgcccggtctacgacgtgctggtccggcgcttaggggcttcctttatgcagtactgcctgcgaccggaaatagggaaggtggaaattgcgccgttcgcctatatgcgtggacgtacctttgaaaatgcagtcgtcattcttgacgaggcgcagaatgtgactgccgcgcaaatgaaaatgtttttaacccgcctcggggagaacgtgacggttatcgtcaacggtgatatcacgcaatgcgatttgcctcgcggcgtgtgctccggattaagtgacgcgctggaacgtttcgaagaagatgaaatggttgggatcgtccggttcggtaaagaggactgcgtacgttcggcactttgccaacgtacgctgcatgcctacagttaagtgtgttatcggtgcagagcccgggcgaaccgggctttgttttgggtgtttatgcccggactagcgctttttctgaaacaaccatttttatttgcccctggctggtgaagtgtacgctcatcctgtggcttttttgtagttgctgatagagctcatcaggtattgctaagctctctgcatattcttgcggcgtatattggtaggctgcatgatgctgctgtttttgaaaacgcagcttattgtacagcgcccagacaattaacacgacggcattcgccactgccagcaaaaaatagaactgaagtcggcttctggcctcgctttgccagtaataacccgtcagcagatccatggcgaataagaatatgaacaacgcaaataatgtccacaagatggttgtggcaacataatcaaccagtaaacgtactggtgattgtcgggtcgtaataattaaattgttcatattaacctctcagaatcccgcgatcgggacttacccaacgggcgcgttgctttttaggcatcaacatgactcgtgtaaatgataccaatgtcgttgccaggctcagcatccagaaaataaccgggaaccaaataatccagaaaagcgatgaagtcagattatgctcatagcgattctcgatcatcaggctgacaataaattgcagtaaacataacgtacacaataatattccggcagtatgtgtcgcagcgatatgtgtcaattcaatatttaacggtacaccggcaagttggactgcgtaaataatgaaaccgaccaggcaggtgaaggcccatattgtcgtcaggcagtattcaaaaaacagcggccacattcgaaagttttctttgcgccacaaccttgtcatatttttgaggaatacttctgcaccgccctgagcccagcgcaggcgctgtttccacagcccttttaacgtttcaggcattaatatccagcacagtgcccgtggctcgtaaaaaatcgtccactgattcaactgcagcttccagctaatatcaatatcttcggtgatcatatcgtcactccagtaacccacttctgccagggcgctgcgacgaaatgcggcaataacaccggaaacggtaaatacgtttccatagatacgctgggttcgcttgatcaaaccaataattgaggaatactcgccaacctgaattttacccaccagggtagaacgtgttcgaatacgaggattaccggttacggcacccacacgcgggttgtacaacatcggttccacaatatatgccgccgcatcgcggtctaataacgcatcgccatcaatgcacaccagatattcacttttcgccgcggcagctccggttttaagcgcaatggctttcccctggttttgcgccagatgaatgacccgcaaatggggaatttgtgcagccatgcgatccaggatggcacgggttttatctgttgaaccgtcatttacggcaataacttcaatgttctcataacgctgtgctaaagcggcgtgtatggtttcctcaacgtttttctcctcattaaaacagggaatgataatggagatagacggattatctttcaactggggagctggtgcgttttctccccacggccagtggcgttcacgatagacccagaaatagacgccgccaacaatccacataatggacataaaaaacggccagaagaaaacgaacctcatcatcagttcaccagagtgaaagtacgctacgcataggggtatgcataacaccagacataatataaaaaacgatacgatgcgattaatcatttttcggataccaggctgttgaaaactcaggacgaataaggtctatttcaggttggttatgcagaaaattgtcgggataataaccatagtttttcactccattcagttgtaataggctcatccagtgagcgagttgttgcgaagaaatagcctgatgctgaccatttttctgccagttttgtgcctgtaattctaaaatagatttgtctttagcctgagggatgtttttaatttgattggtcaattgtattaaccattggtcagccgatttttctgcgacaccttccagataaggcatagccataatagcggtccagtcatagctttttaggaaatcagcataattctgtgcaaaccaggcttcactttcaggttgtattaccggaagtgcaaaaatatttcgtgcagttttaatatgtggaccgcgaatggcttttacgcgcgcactaagttctaaagtgaagtcagttaacgcacgacttttaaagcgggcccactgtttaaattgctccgggttttgtcgaatttcgctcagactcccgctaaagcctgcttgctgataagccgtgatagccggtgcactggcatcttcataatctgaaagcaaagcatcatcgtggaacaatatgccatcaaaagcagcatgtccggcaagatcttcatataacatgccaacttgtgctctgactctgtcatcgaaaggagagagacggtgatattgttcaggatgaatttgtgcttttttctcccctgttggtaagtattttactcgcgttaatgtgggatctaaatcccagcttaataccggcatccacgcatagatgtttacacctgagcgggtacgtaattgccaggcaacccgactaaaaatatctgctttcattggtagcaaacgatttggaaaccagacctctttgaccagcccatcaccatcgggatcagcaaatgcctgcaaatacacggttgatatttgcatatctttcacccgctgaattagcacatcaatattgcgatccatttgctggaggttttcgtcataaacgtaatcaagatcgatatgcattatccgttgtggtgatttttcctgtacggtaataatttgctgggcaaactcttttaatgagggattattggcgattaatacccgcggaatggaatccaattgcgacgcatttgccaaacctgattcaagggtgaagaacatgtcataaccgagtttttttaattcctctatcgctatgccattcgcttcgccataaggccaaacaaaaacgtgtggatttacctcaacctttgtacgcaggtattccgtcatttttacagcatccagacgaattctttcccggtattctgctgcggtttcataccgtgcgtggtcagtaaaatatgcacgatttacatatacaggcaataagctgccggtggcattagcctgaataccgtagtgagaattccatgtatgagaagcgagctcaacgagccgggaacgcgcaacttctcgcacttgttgccacgtggcaaaatattctcgatcgaccaactcatcgccaaattttacttgtttatccgctggcgtatcgacccaactgccgacgggggcccatacagcaggccactggaaggcctgaagaattgggaagacgcgggtataaaaactctggtagccgtcatcaaaagtcagcactacagctttttccggtagcggttttcctcctcgatgtgcttcacgaatttgagcaatactgaccggttgataaccgttctcgcgcagccaggcaaattgttcacgcagtgctgatgtccgcactgacataaaacgctggtcggcagcttcgtcttcaacgttatgccatgaaatcgctacaaaaccattatgcggccacggttgctcggcgagtaaagattcgcgatcctgtggcggtataaatgatgttcttgactggctaatgcacgcggtgagcataattatactcaccagcatcaggagatatttatttccattacgtaacatatttatccttaaaatctgaatgtcatatcgaattcaacgtataagttgtgttctctgtcaccgtcataaggtcgtttttcccagcgtagcgttgcgccagcatcaatcacgtcattccaactaatgcgttgcccgtagccgagttgggtgacgacatccgtgccataatgtttttgccaggaggcaccaacacctgcgctgaatatttgctcccagctattttcatagcttcgccataacaaatggcttgcctcaaatgccggaacaatatcgaacgtttttatagggttgtagtatggggtatcgtgttctgtattttgttcgtaatacagactgggtaggaaatcgacaatcaaatatggtgaagaccagatgcgttcctgaccctcaagtgagacttcatgacgctggttactgtcggaaaaatcagtgaaagcccaggagacaccgtacttacgccgctcattttgataccagcgaacataagcctgagcactgttgcctgtaacaccatttttcattgcccgtaatggaacgcggtgagagaggcgttccagttgcgaaccaatacgccagttatcattaaaatcataccagccagacaggcgcgcgccgggtttatgctcatgattgaaaacgcgttcagcgtactctgcctcgagccagatattacgtgaccgccactcaacacccgcaagccagtcgcgaacaatcccttttccttcgctaaattgtccatcggcataaccgaatccagcaaaaccgcgccagttatccttcagcggtggtgaataaacgatggtggttaagtcgacatcatgtttaccactatccgggccttcggcatcaattcctgttgagccagcgatacgaagctctgcaagattatgtacatcaaccgcacgttttaatcgtacaacgccgggatcttgcggttcacgttcgacaacatcgtgcgttaagacagctgcctgctgccattcttgtaacgttaatgctgtccaggcttgttcaacctccagattaatattacgtggctcgatcacttctgctttttttaattcattttctgctgcacgaggccaaccgcgggcttgtaacacactcgcgtaatcaatgcgcagtccctgatttcctggtgcgttataagcaagctctctggctgtcatttcagcctgaggaagatcattactatattttgctacggttgagagaaacgaatgcccctgtaaccaggtatcattcgggatgctcgtaggcgtgcccattaaccgaaggaaaggcggcgaagtattaatggtatgttgggtgacagttagcgcgcccggataattttcactctccaggtggctgtaaaagagatccgcaagttcttcatcggataaatccggggcaatggtctccttgtgataaaagagctcggtcattattgactgtgcttttttcggctgatgatctttgagataagccgatgcaacccaatattgcccccagggcggaataatttgccccgtcttttttaatcgctgatagtgagaaataacgtctttataacgatcgcgagttaataacgcgccaagatgatcaacctgaatacgctggtactgggcagtgcggtctgggttatcgtgccacagaatttctaatgcagcgtattgggcgagggcgcgatcggcaatggcataacgttcactttcactgcgcgtaggcataaacgacagtctgaccagttcggcatgaatatcagcgcgaatatctggcgttaaattggcatcgtcaatcgcggcagcaagttgattattacgtaatgcctgcacgtattctgtgggatattgttgcgtagatgcattttcaggtaatgactctgtcatcgcccgtaattcatcctgatgacgccccgccagtttatagatataggcttctgcgagtaaattggctttgtccggtgctccagagttaagctgcttaagtttaaccagcgcagtatcatagtgaccagcatctgccagggttaaaatttgtccccgttgataatccttattttgcggctccagagagagcgccttttgccacagtgtaagcgagttttgccattgttgcaggttacgataagcgacggcgacagctgcataaccacgcgctggtaattgctgatgacggtagcggttgtaaacggtaataacctgtttatcttgcccggcccataaggcaatctgtaaccagtcagcaatttggttattgctgagtgctgattttagtgcaaaccatgacaaagctggctgagtattacccttgcgagcttcaataatcaatgcatcataggcgttattaacagcactcttcgccgcgggactcgctgctaaaaatgcggcagtaagaagtttcaaagcccatttggttttcgggcacctttttctgctacttgaatacatcctgtattactccatgtattgccaaaatctctctctgtatctaattacaggtaactgaaaagaaagatatttttgcacctcataatccgttattaaacgcggaagagagacgtgaattgttgatgatgagaagaagaaatgatgagcagagtgtccatataaaatccttttctcgcccgaaaatccattccaatgatgaggatcttcaggaatacggcataaatcccaatgcctttttcaaaataaattaggattaaaataattaaatcagtaaattccgatgcatgatttcggatttttcgaaagtcctgatgaaaggctgcgctacggcactcacggatttaattgttattcctaatgtatctatgaattaatgttttataaggattttctataaccatttataagtattttcaagcctggcttgttgcaaacaatgtataaagcacttaggcaataataattacattcagcaactatcatcatcggtattgtttgtgggcggaatttcatattgacaacagtacagttcttatatctattaataatagaaagggatctacaacctacagattggtgtagctttatggaaaaagactatttgagaattagtagtactgtattagtgagcttattgtttgggcttgctttggttttggtgaatagttggtttaatcagccaggcgttgaggaagttgttccacgatcaacctatctgatggtaatgattgctttattttttatcgatactgttgcatttatttttatgcagttgtatttcatttatgaccgtaggcaattttcaaactgtgtacttagtttggcttttctgagttgtttgatttactttgttataaccgtcattatcattcagcaaattattgaggagcgtttgacaagcagtgttgtccaaaatgacattgcaatctattatttgtttcgtcagatgagtttgtgcatattaatatttctggcattggtgaataaagttagtgaaaacacaaaacagcgcaatttattttccaaaaaaatgactttgtgcataagtttgttttttgtttttggggggccgatagttgctcacatactttctagtcattatgagagctacaatttacacattgccgagttaaccaatgaaaatggtcaggtggtttggaaagcctcatatgttaccataatgattttcatgtggttaaccttgctttcggttaatctatactttaatggtttacgctatgatatctggaatggagtgacggtgattgctttttgtgccgtactgtacaatatctctctgttatttatgagcaggtatagcgtgtccacttggtatattagtcgcactattgaagtagtcagtaagttaaccgttatggtaatatttatgtgccatatattcagtgcgctacgagtaacaaagaacattgcacatcgcgatcccttaaccaatatatttaacagaaattatttttttaatgaactgacagttcaatcagcatcagcccaaaaaacgccttattgcgtcatgattatggatatcgaccacttcaaaaaagtcaacgacacctgggggcatccggttggcgatcaggtgataaaaacagtggtgaatatcattgggaaaagcatacgaccagatgaccttttagcgcgcgtcggcggcgaagagtttggcgtcttgctgacggacatcgatactgaacgtgcgaaagctttagcggaaaggattcgggaaaatgttgagcgtttaactggcgataatcctgaatacgctataccacaaaaagtgacgattagtattggcgctgttgtgactcaggaaaatgcgttaaacccaaatgagatctatcgactggctgataacgcactttacgaggcgaaagagaccgggcgtaataaggtggttgtgagggatgtggtgaatttttgtgagtcaccataaagcggcattttgatcctacccacgtaatatggacacaggcctaagcgaggttcttgttttcaaattgttccggactgaggccgccacaccaactgtgccgccgccaccgattgtaatcacattcgatataattaaacaccgttgcccgcattatttcccggctgataaagtgttctccatggatacattccactttcagcgaatgaaagaagctttccacgcaggcattatcgtagcagcaaccttttgcgctcatacttccacgcagattatgccgcttcagttgcgcctgataatctgctgaacagtactggcctccacggtccgtgtgaacgataacgttccggggcctcttacgccgccacagcgccatctgcagggcatcgcaggccagttgcgccgtcatgcgtggcgacattgaccagccaataacggcacgtgaccacaggtcaatgaccactgccagatacagccagccttcatctgtacgtaagtacgtgatgtctcctgcccacttctggttcgggccactggcgtaaaaatcctgctccaacagattttctgacacaggcaggccgtgtgcgcggtagctgaccgggctgaacttccgggaggcctttgccctcagtccctgacggcgcaggcttgccgccacggtttttacgttaaaggggtaaccctgagcacgcagttcatccgtcaggcgtggggcaccgtaacgctgttttgaccgggtaaaagccgcgaggacaacgctgtcgcagtgttggcggaactgctgacgcgtgcttatccttgtccgccgctgacaccacgtataccagccgctgcgggccacccggagcacgcggcacattgctttgatgctgaactcagcctgatgtttttcaataaagacatacttcatttcaggcgcttcgcgaagtatgtcgcggccttttggaggatagccagctcttcatcccgttctgccagctggcgtttgagacgtgcaatctcggtagacatctccagttcacgttcagaagacgtctgctgattttgctgtttactgcgccagttgtagagttgtgattcatacaggctgagttcacgggctgcggcagtaacaccgatgcgttcagcaagcttcagggcttcactgcgaaattcaggcgaatgctgtttacggggttttttactggttgatactgtttttgtcatgtgagtcacctctgactgagagtttactcacttagccgcgtgtccactattgctgggtaagatcagtgcctggcacacgcgtttgatggaagacggcgttcaggcaatgcgcgattatcttgccggactggatatcgcttcgccagagcatcaggttctgatgaacgtaacagcaaaaagcgaggtcgctccgtcaattatcaaagaaaatctctcattacacttaactcatacggtgaaatggactgaatctctcgatacatttctgaatatgccaaccccggtagctttccttgaaataagtaataagccctatttggggaatatgttaaatgattttgctggcgtggatcagcaacgagttatgcattgtcgtaaagcatttagtgatgcaaaggtattcaaatgattcctgattatttaacttttattcgctttcaggataaacgaaatctgatatacatttatgctattggacttattctgataggcttttattggaagaatgcagggtttacttttccatcagaggatattggtgtagttagtgggattctggctctggtgctgtataattttatttttgatctcaaggcgtactgggcttataaatgcgtcacgaagaatatcgatttttcgtggtttaagaaaaagcagaaccacaaaatagaattatttcttacacaacctctggtggcaggatttctgtcgttaatcatgttgagtgcaatgagttgggggctataccagcttctaccctcgttatatgcgctgttcctgatttcgttacttgggccgttggtcatctttctgctgtttcggatgatccgcaccagttatgtcaagcaggtcgctatttcagtagcgaaaaaagtaaaatataaaagtctgactcgctatgtgctgctttcggtgtgcatctcaacggttgttaacctgcttactatcagcccgttgcgtaacagtgattcttttgtgacagaggggcagtggttaacgtttaaatcgataattgcattgctcattctttgtggcgtagtgttggcgattaatctgttttttctgcgcttctccaagcggtacgcttttctgggcaggctttttttgcaggaaatcgatctgtttttctccagtgaaaatgcgttgtcgaccttttttgccaagccgctttggcttcggttattcatattgctggttattgaagtgatgtggattacgctggtgtcggtattggcaacgcttgtagaatggcggatttggtttgaagcctattttttactctgctatgtaccgtgcttaatttactattttttctattgtcgattcctctggcataacgattttatgatggcatgtgacatgtatttccgttgggggcattttaataagtgaggaagtgataggaagtgaccagataatacatatatgttctgtactctcttgcgcattttgattgttgactgagtaaccagacagttgatgtgcacgatttcccctcgccctaacagacgtgggcgggggcacccggtgtgtgcaatatacgaaaaaaaagcccgtactttcgtacgagctcttctttaaatatggcggtgagggggggattgactcgcttcgctcgccctgcgggcagcccgctcactgcgttcacggtctgtccaactggctgtcgccagttgtcgacccccggtcggggcttctcatccccccggtgtgtgcaatacacgaaaaaaaagcccgtactttcgtacgagctcttctttaaatatggcggtgagggggggattgactcgcttcgctcgccctgcgggcagcccgctcactgcgttcacggtctgtccaactggctgtcgccagttgtcgaaccccggtcggggcttctcatccccccggtgtgtgcaatatacgaaaaaaaagcccgtactttcgtacgagctcttctttaaatatggcggtgagggggggattgactcgcttcgctcgccctgcgggcagcccgctcactgcgttcacggtctgtccaactggctgtcgccagttgtcgaaccccggtcggggcttctcatccccccggtgtgtgcaatatacgaaaaaaaagcccgtactttcgtacgagctcttctttaaatatggcggtgagggggggattcgaacccccgatacgttgccgtatacacactttccaggcgtgctccttcagccactcggacacctcaccaaattgtcgttcctgtcttgctggaacgggcgctaatttagggaaatcatgacctgaggtcaacaaactttttgaaaaaatcgcgcgtttattcaaacttcaatcaatgtgtggttttaataagcgaaatctgctttttttgccaccgaccacggatttgttatgctggtggcctttgtagatcataacgataagtgcgaataaatttcgcacaacgcttttcgggagtcagtatggatatcatcttttatcacccaacgttcgatacccaatggtggattgaggcactgcgcaaagctattcctcaggcaagagtcagagcatggaaaagcggagataatgactctgctgattatgctttagtctggcatcctcctgttgaaatgctggcagggcgcgatcttaaagcggtgttcgcactcggggccggtgttgattctattttgagcaagctacaggcacaccctgaaatgctgaacccttctgttccactttttcgcctggaagataccggtatgggcgagcaaatgcaggaatatgctgtcagtcaggtgctgcattggtttcgacgttttgacgattatcgcatccagcaaaatagttcgcattggcaaccgctgcctgaatatcatcgggaagattttaccatcggcattttgggcgcaggcgtactgggcagtaaagttgctcagagtctgcaaacctggcgctttccgctgcgttgctggagtcgaacccgtaaatcgtggcctggcgtgcaaagctttgccggacgggaagaactgtctgcatttctgagccaatgtcgggtattgattaatttgttaccgaatacccctgaaaccgtcggcattattaatcaacaattactcgaaaaattaccggatggcgcgtatctcctcaacctggcgcgtggtgttcatgttgtggaagatgacctgctcgcggcgctggatagcggcaaagttaaaggcgcaatgttggatgtttttaatcgtgaacccttaccgcctgaaagtccgctctggcaacatccacgcgtgacgataacaccacatgtcgccgcgattacccgtcccgctgaagctgtggagtacatttctcgcaccattgcccagctcgaaaaaggggagagggtctgcgggcaagtcgaccgcgcacgcggctactaataaagcatcaggattcctgctatccttggcgggaattgaatacaggagagagttatgtatcccgtcgaccttcatatgcataccgttgccagcacacatgcatatagcacattaagtgattacattgcccaggccaaacaaaagggcattaaactttttgcgatcaccgatcatggcccggatatggaagatgcgccgcatcactggcacttcattaacatgcgtatctggccgcgagtggttgatggggtagggatcctgcgcggcatcgaagctaacattaaaaatgttgatggtgaaattgactgcagcggtaaaatgtttgactcgctggatctaattattgccggttttcatgagccggtttttgcgccacatgacaaagcgaccaatacacaagcgatgatcgccactatcgccagcggcaatgtgcatataataagccatcccggaaatcccaaatatgaaatagatgtgaaagccgttgctgaagcagccgcgaaacatcaggtggcgctggaaatcaataattcctcatttttacactcacgtaagggcagtgaagacaactgtcgtgaggtagccgcagcggtacgtgatgctggaggttgggtggcattaggctcggattctcacaccgcgtttaccatgggggaatttgaagagtgtcttaaaatcctcgacgcggtagattttccgccagagcgcattttgaatgtttctccgcgccgcttactgaacttccttgaatctcgcggtatggcaccgattgcggaatttgcagacctttaattactagtaatggaaatatattaatgaacgagttttctatcctctgtcgtgtgctgggttcgctctattaccgccaaccacaagatcctttactggtgccgctgtttaccctgattcgtgaggggaaactggctgcgaactggccactggagcaggatgagttgctgacacgtttgcagaaaagctgtgatatgacgcaagtctctgccgattacaatgcgttgtttatcggcgatgaatgtgctgtgccgccatatcgtagcgcatgggttgagggcgcgacggaagcggaagtgcgcgcttttctttctgagcgagggatgccattagcggatacgccagccgatcacatcggcacattgctgctcgcagcttcctggctggaagatcagtcaacggaagatgagagcgaagcactggaaacactgttcagtgagtatctgttaccctggtgtggtgcgttccttggcaaagtggaggcccatgcaaccacgcctttctggcgcaccatggcaccgctaacccgcgatgccattagtgcaatgtgggacgagctggaagaagattctgaagaataagtgtgatctacgtcactcataactgcaacggataatttgttgttgcataaaatgtgtgctcgatctcattcatggccgcgttttctgctatcatgcgcggcatgaacatacttctctctattgcaatcacaacaggcattctctccggtatctggggatgggtggctgtttccctgggcttactaagctgggcgggcttcctgggctgtacggcctactttgcctgcccgcaaggtgggctgaaagggctggcgatctccgctgcaaccctgcttagtggcgtggtgtgggcgatggtcattatttacggtagtgcactggcaccacatctggaaattctcggttatgtcataaccggtattgtcgcgtttctgatgtgtattcaggccaaacagctgctgctttcatttgttccggggacgtttataggcgcatgcgcgacgtttgccgggcagggtgactggaaactggtgttaccttcgctggcgcttgggctgatatttggttacgcaatgaaaaacagtggcctgtggctggcggcgcgtagtgcaaagacggcgcaccgtgagcaggaaatcaaaaataaagcgtgaggggcactcacgctttcgcttaaacagtaaaatgccggatgataattccggcttttttatctgtcaggattccggtggaaccgacatatggcggtatttcaccagaatgtcattctgccgttctgctttattttgcaaatcccacagaccacggtcgataccatcattaatcaggaaaatgacccctgtttcgatagccgacatcaggcacagcataacaggttcgttcgaggtgtaacccacttccccttcaagcaagcgctggtagtcaataaagcggaaaaccccggcctgaacttcataggaaagtatcgtcttactggtgttcaccgaagaaaggatctcgccggtactcacattgacgacgcgcaggttcacggcaatctgatcgagctggtattgcgtgtcggcaccgatgccaaaatatcttgccccaaccccgccagatttgacgttgctttcataaccgataatcgaaccttcaaccatgatatttgccgccgttaaagattgcagcgggattcggttattaatggcaaccgtgccgttttcttgtgccgcacgaataatcttgcgctcgttaagcaggttttgtaagccctggcgctccagcggtataaaccagcgagaatctttcagtgccgtgaccagcattgccgtggcgctttgcggaacagcagtggagaagttacttgccgggtagggtttaaattgcccggtttcgtcctgaatgttgtataccgaaacaaagattttacccgtcggcgctggcagatgggtcaaatctttgtagctctgagcacgaggcattaatgtcggtctggcggcttctttaggcggggcggttaagcatccgctcagtaacatgacggcaaccaaaagaaataagcgctgcatgattattttccttatgaagctggggcttaaaaatcggttgagttattttgtaaacccgaaacctggatggtcgaggtttgtccggttttacgatctgtcacgttcaactgcaattgaccatcgcggttggcaatatcgacaatataatcgttggtcaccatgcggcccggtttaccggtattaatattcgacagtagcccacctaaaatttgtgactggatggcctgagtaaagttatctaacgctgagggtgtttcaataccaaagtcatcgttatagctcggatctttataagagttttgggcctgagcgctatttaataaaaaagcgccattatttgggttaccaccaaagtttggattacggaactggaaagtcatggttccagcccaacttaatggcgaaataagcatgagtagaactactgcatgtttgacacgcattgcagcctccgaacaattttttatttagaattcatcatgcgccaaatcgcccgtacttaataacgcctgatttatctggcgacgatttagtgcttcttcagtttgaatcagtgcaaagacgacagttttctcgaagtctcttttcaacggaaataaaaaagtctggaaaataacgtcctgattgaccgttatagtgatccagcttccccatcgtgcactgggcctttcattaatcgttaagttacccgtatagtcactttcccatttatcactaaaggctcggtaaaaatcatggccaatagatgaaacagtatggtcagttagcaatcccgggacttctacctcaacggcgtgaagattccctgcggcgaacagaaattctgccgccacaatccagcgtaaataacgtttcatggctttatcgcctgaggttatcgtttgcccaggaaaccgcttgtgtccggttttttacggctatcttcttgaaaagattataaagatgcgttttaaccgtattttcgctgatgaacaacgaacgagcgatctcgttattagacgcgccgatacgcagcttattcaggatctctttttcccgatgagtaaggagggctgattccgtgctgttataacgatagttacctgaatgcgtaatcaggtagctggcaagcttttgcgtaaagtagcattcgccgcgcaggacgccttgcaacccattgacaacacgttcttgatcctccatggaataaaaaacgccgttgatatgaggccagttttcaatgtcgcggtacgggtaatcttcaggcgtatttagcaacaatattttgatattgttgtttttcctgctcaaagtatcctgccaataatggataagctttttatccgcttccatcatatccagaagaataatagagcctgaagagatatcgtccagagaacgttgaatattatgtaattttcctgtaattgccagcgattgtttaaggtgctgcaagagagctgtcgcctgcaaagaagatttagtgatcaacaataatgtatgaccatgaatactatggacttcattaaacatgatgaaaccccgctttttttattgatcgcacacctgacagctgcctctaaaatagaagcaccagaagtactgacagatgttgcactgctgtgtgtagtaataaatcagccctaaatgggtaaaatataaaactaatggattacatctgatttcaatctagccattacaaatcttaaatcaagtgttaaacatgtaactaaatgtaactcgttatattaaaatgttaaccttaaggttttattaagtttagaaatgatagaaaagttgtacatttggtttttattgcacaattttaaaaaatcatacaaatggtgataacttactaataatgcatataaaaaatatttcggtgtagtcctttcgtcatgtaaaacgttcttgttttttctccacacctccgtggacaattttttactgcaaaaagacgaggtttgtcacggcttgtgcgcaagacatatcgcagcaatcagcgacgggcaagaagaatgactgtctggtgctttttgatagcggaaaacggagatttaaaagaaaacaaaatatttttttgcgtagataacagcgtatttacgtgggttttaatactttggtatgaactaaaaaagaaaaatacaacgcgcgggtgagttattaaaaatatttccgcagacatactttccatcgtaacgcagcgttaacaaaatacaggttgcgttaacaaccaagttgaaatgatttaatttcttaaatgtacgaccaggtccagggtgacaacatgaaaaacaaattgttatttatgatgttaacaatactgggtgcgcctgggattgcagccgcagcaggttatgatttagctaattcagaatataacttcgcggtaaatgaattgagtaagtcttcatttaatcaggcagccataattggtcaagctgggactaataatagtgctcagttacggcagggaggctcaaaacttttggcggttgttgcgcaagaaggtagtagcaaccgggcaaagattgaccagacaggagattataaccttgcatatattgatcaggcgggcagtgccaacgatgccagtatttcgcaaggtgcttatggtaatactgcgatgattatccagaaaggttctggtaataaagcaaatattacacagtatggtactcaaaaaacggcaattgtagtgcagagacagtcgcaaatggctattcgcgtgacacaacgttaatttccattcgacttttaaatcaatccgatgggggttttacatgaaacttttaaaagtagcagcaattgcagcaatcgtattctccggtagcgctctggcaggtgttgttcctcagtacggcggcggcggtaaccacggtggtggcggtaataatagcggcccaaattctgagctgaacatttaccagtacggtggcggtaactctgcacttgctctgcaaactgatgcccgtaactctgacttgactattacccagcatggcggcggtaatggtgcagatgttggtcagggctcagatgacagctcaatcgatctgacccaacgtggcttcggtaacagcgctactcttgatcagtggaacggcaaaaattctgaaatgacggttaaacagttcggtggtggcaacggtgctgcagttgaccagactgcatctaactcctccgtcaacgtgactcaggttggctttggtaacaacgcgaccgctcatcagtactaatacatcatttgtattacagaaacagggcgcaagccctgttttttttcgggagaagaatatgaatacgttattactccttgcggcactttccagtcagataacctttaatacgacccagcaaggggatgtgtataccattattcctgaagtcactcttactcaatcttgtctgtgcagagtacaaatattgtccctgcgcgaaggcagttcagggcaaagtcagacgaagcaagaaaagaccctttcattgcctgctaatcaacccattgctttgacgaagttgagtttaaatatttccccggacgatcgggtgaaaatagttgttactgtttctgatggacagtcacttcatttatcacaacaatggccgccctcttcagaaaagtcttaatttgttgaaatatcgagcataagatgaatctggagagaatggtctgctgcgaatcagccaacctgaaagtatggataacacaaccctcaaggatgactaatcattgaggaaatagaataaatgttcagaccttttttaaactctcttatgctcggcagtttgttttttccttttattgccattgctggaagcaccgtgcaagggggcgtgatccatttttatggccaaattgtggaaccggcatgtgacgtcagcacccagtcatcacccgtagaaatgaactgcccacagaatggttctattccgggcaaaacctactccagcaaagcgttaatgagcggcaatgtcaaaaacgcgcaaatagcctcagtaaaagtgcagtatcttgataaacagaaaaagctggctgtaatgaacatcgaatataactaagtttctgaacaactcacgttgctgagcagaaaaatgcgatttaaccaaaaagcctgctgtacacttaagaaacaagaaggtgtaaggaggcgttatgaaaacgcgtattcatgttgtgcagggtgatattaccaaactggccgttgatgtgattgtgaatgcggctaatccgtcattaatgggaggcggcggcgtcgatggggccattcatcgcgcagcgggtccggccctgctggatgcttgtttaaaagtcaggcaacagcagggcgattgccctacggggcatgccgttattacgcttgcaggcgatcttcccgctaaagccgtagtgcacaccgtcgggccagtctggcgtggtggtgaacaaaacgaagaccagcttttgcaggatgcctatctcaatagcctacgactggtggcggcaaacagctatacgtcagtggcttttcctgcaatcagtactggggtttatggttaccctcgtgcggcagcggctgaaatcgcagtaaaaaccgtttcagaatttattacccgtcacgctttacccgaacaggtatactttgtctgttatgatgaagaaaacgcccacctctacgaaagactccttacccaacaaggagatgaatgatttgccccggctggcgagcgcggtgctgccactgtgttcgcaacatcccggtcagtgtggcctttttcctctggagaaaagtctggatgcgtttgccgcccggtatcgtctggccgaaatggcagagcatacgctcgatgttcagtattacatctggcaggacgatatgtcgggtcggttactgttttccgccctgttagccgcagcaaagcgtggcgttcgcgtccgtttgttgctggacgacaacaatacgcccggacttgacgacattttacgcttgcttgacagtcatccacgcattgaagtccggctttttaatcctttctcgtttcgcttgctgcgtccgcttggttatatcaccgacttttcccgtcttaatcgccgtatgcacaataaaagtttcactgtcgatggcgtggtgaccctggtgggaggacgaaatattggtgatgcctattttggagcaggggaggagccacttttttcggatttagatgtcatggcaataggacccgtggtagaggacgttgccgatgatttcgcccgctactggtattgcaaatcggtttcacccttacagcaggtgctggatgtcccggagggtgaaatggcggatcgcatcgagttacccgcctcctggcataacgatgccatgacgcatcgttatttacgcaaaatggaatccagtccatttataaatcatctggttgatggaacattgccgcttatctgggcgaagacacgtttattaagtgatgatccggcgaaaggggagggcaaggcaaaacggcattcactgttaccgcagcgcctgttcgatatcatgggctcacccagtgaacgcatcgatattatctcttcctattttgtaccgacacgcgcaggtgtggcgcaactcttacggatggtgagaaaaggggtaaagattgcgatcctaaccaattctcttgccgctaacgatgttgctgtcgtccatgccggatacgcgcgctggcgcaaaaaattgctccgctatggcgtggaattatatgaactcaagccgacgcgtgaacaaagtagtacgttacacgatcgcggcataaccggtaattccggagccagcctgcatgctaaaacctttagcatcgatggtaaaacggtgtttatcggctctttcaatttcgatccgcgttcaacattgctcaatactgaaatgggcttcgtgatagagagcgaaacgctggcacagttaattgataaacgctttattcagagccagtatgatgcggcctggcagctccgtctggacaggtggggacggatcaactgggttgatcgtcatgcaaagaaagagattattctcaaaaaagaacccgccaccagtttctggaagcgggttatggtcagactggcgtcgatattgcccgtggaatggttattgtaaatgtggcttaacgggctggtgctttatcgttctcacgcttaacaaccggtttaccagagaacaaaaacttcagtaacgggatgcgcaaatgaatttcatacagaattatcgcaatccctactacaaatatcaggccacagagaaaaccaagccagttggaggtgatgtgcggtgtaatgtatgcgccgaaaaacagcgttaacgggtggtgaaccagatagataaacagcgatgcgttaacaaaataagtcacccgcgctgactggaagttaagcaaacggtggccaaaggagaagaccacattcaccatccacagaccgaggaccatggtgatcaccgactcggtttcgtacatccaggcatcgccactgccatagcgctggttgagtaaataagcgacaaacgccaatgctgctgcaagggtacagccacgagacggcgtggtaaacaaggctttaagatgagggaaaatgaaagccagtgcgccgaggataaagaacggcaaataaaacagcgtttgcatgacaataaaattgaacatgccattactcagaatgggcggatacacaataaaaatcgttcttcttattaccgcataaccgatgccgaggcataaaaaaatcaccgatagttttaccatcgagaattttttattcgttttatcagaattttctaaattatttctgatgcgcttaaatatccatacgcacagcgtcgtcatgaccactaacaccagtaaaaaccacaggtgtgatattaattcccaggccaacgtattatatttgtcatacaatgacagcccaggccaactttccgcttttcctttgacatattgcagcataataaattgcggtaatgtcagtagggggatggctgttaacatcgggatacctacacgttcgacacgtactttccaccattttttcaagggatagcgtaaaaaaagcatgtaggaaaagtagccggatataacgaaaaatacctgcatgcggaacgagtggatgaagtcattaaaaagggtcagccacaatgatgattcggcgctattcacatgccatgtatggctcgaatagattaaagaaatatgaaaaggtatccctaacaacatcagccaggcgcggatggagtcgaggaaatattcacgttgcgcgggtactgggttcatatatggttaactaatctcggatttttcgtcttatccctgtcgggttatgcctttaggcttgttgccatagtgacaccgacctgaccgcgccaggcgcaggcttcaaggtttttatgcatagcatcatcgctaccactaaccagaatggaagcgtctgtaagacggttgataaataaatttgctggcaaaccctacacgaagtcgatgcttctgtctttaggagaagcacggaaagtgaaaacggttgcaatcaggtgcttaatccatgagccagcgtgctgaacgataccgggattctgttgtcggaatggctggttatccattaaaatagatcggatcgatataagcacacaaagggggaagtgcttactaattatgaaacataaactacaaatgatgaaaatgcgttggttgagtgctgcagtaatgttaaccctgtatacatcttcaagctgggctttcagtattgatgatgtcgcaaagcaagctcaatctttagccgggaaaggctacgagacgcccaaaagcaacttgccctccgttttccgcgatatgaaatacgcggactatcagcagatccagtttaatcatgacaaagcgtactggaacaatctgaagaccccattcaaactcgagttctaccatcagggtatgtacttcgataccccggtcaaaataaatgaagtgactgccaccgcagtcaaacgaatcaaatacagcccggattatttcactttcggcgatgttcagcatgacaaagatacggtaaaagaccttggctttgccggttttaaagtgctttacccgatcaacagcaaagataaaaacgatgaaatcgtcagcatgctcggggccagctatttccgcgtgattggtgcaggtcaggtttatggcctttctgcccgcggcctggcaattgataccgccttgccatcgggtgaagaatttccgcgcttcaaagagttctggatcgagcgtccaaaaccgactgataaacgtttaaccatctatgcattgcttgactcgccgcgtgcgacaggtgcttacaaattcgtggttatgccagggcgtgacacggttgtggatgtgcagtcgaaaatctatctgcgcgataaagtcggcaaactgggggttgcaccgttaaccagtatgttcctgtttgggccgaaccaaccgtcgcctgcaaataactatcgtccggagttgcacgactctaacggtctctctatccatgccggtaatggcgaatggatctggcgtccgttgaataacccgaaacatttagcggtcagcagcttctccatggaaaacccgcaaggctttggtctgttgcagcgcggtcgtgatttctcccgctttgaagatctcgatgatcgttacgatctccgtccaagcgcatgggtgactccgaaaggggagtggggtaaaggcagcgttgagctggtggaaattccaaccaacgatgaaaccaacgataacatcgtcgcttactggacgccggatcagctgccggagccgggtaaagagatgaactttaaatacaccatcaccttcagccgtgatgaagacaaactgcatgcgccagataacgcatgggtgcaacaaacgcgtcgttcaacgggggatgtgaagcagtcgaacctgattcgccagcctgacggtactatcgcctttgtggtcgattttaccggcgcagagatgaaaaaactgccagaggataccccggtcacagcgcaaaccagcattggtgataatggtgagatagttgaaagcacggtgcgctataacccggttaccaaaggctggcgtctggtgatgcgtgtgaaagtgaaagatgccaagaaaaccactgaaatgcgtgctgcgctggtgaatgccgatcagacgttgagtgaaacctggagctaccagttacctgccaatgaataagacaactgagtacattgacgcaatgcccatcgccgcaagcgagaaagcggcattgccgaagactgatatccgcgccgttcatcaggcgctggatgccgaacaccgcacctgggcgcgggaggatgattccccgcaaggctcggtaaaggcgcgtctggaacaagcctggccagattcacttgctgatggacagttaattaaagacgacgaagggcgcgatcagctgaaggcgatgccagaagcaaaacgctcctcgatgtttcccgacccgtggcgtaccaacccggtaggccgtttctgggatcgcctgcgtggacgcgatgtcacgccgcgctatctggctcgtttgaccaaagaagagcaggagagcgagcaaaagtggcgtaccgtcggtaccatccgccgttacattctgttgatcctgacgctcgcgcaaactgtcgtcgcgacctggtatatgaagaccattcttccttatcagggttgggcgctgattaatcctatggatatggttggtcaggatttgtgggtttcctttatgcagcttctgccttatatgctgcaaaccggtatcctgatcctctttgcggtactgttctgttgggtgtccgccggattctggacggcgttaatgggcttcctgcaactgcttattggtcgcgataaatacagtatatctgcgtcaacagttggcgatgaaccattaaacccggagcatcgcacggcgttgatcatgcctatctgtaacgaagacgtgaaccgtgtttttgctggcctgcgtgcaacgtgggaatcagtaaaagccaccgggaatgccaaacactttgatgtctacattcttagtgacagttataacccggatatctgcgtcgcagagcaaaaagcctggatggagcttatcgctgaagtcggtggcgaaggtcagattttctatcgccgccgccgtcgccgcgtgaagcgtaaaagcggtaatatcgatgacttctgccgtcgctggggcagccagtacagctacatggtggtgctggatgctgactcggtaatgaccggtgattgtttgtgcgggctggtgcgcctgatggaagccaacccgaacgccgggatcattcagtcgtcgccgaaagcgtccggtatggatacgctgtatgcgcgctgtcagcagttcgcgacccgcgtgtatgggccactgtttacagccggtttgcacttctggcaacttggcgagtcgcactactggggacataacgcgattatccgcgtgaaaccgtttatcgagcactgcgcactggctccgctgccgggcgaaggttcctttgccggttcaatcctgtcacatgacttcgtggaagcggcgttgatgcgccgtgcaggttggggggtctggattgcttacgatctcccgggttcttatgaagaattgccgcctaacttgcttgatgagctaaaacgtgaccgccgatggtgccacggtaacctgatgaacttccgtctgttcctggtgaagggtatgcacccggttcaccgtgcggtgttcctgacgggcgtgatgtcttatctctccgctccgctgtggtttatgttcctcgcgctctctactgcattgcaggtagtgcatgcgttgaccgaaccgcaatacttcctgcaaccacggcagttgttcccagtgtggccgcagtggcgtcctgagctggcgattgcactttttgcttcgaccatggtgctgttgttcctgccgaagttattgagcattttgcttatctggtgcaaaggaacgaaagaatacggcggcttctggcgcgttacattatcgttgctgctggaagtgcttttttccgtgctgctggctccggtacgcatgctgttccatacggtcttcgttgtcagcgcgttccttggctgggaagtggtgtggaattcaccgcagcgtgatgatgactccacttcctggggtgaagcgttcaaacgccacggctcacagctgctgttagggttagtgtgggctgttgggatggcgtggctggatctgcgtttcctgttctggctggcaccgattgtcttctcgttgatcctgtcaccgtttgtttcggtgatttccagccgtgccaccgttggtctgcgcaccaaacgctggaaactgttcctgatcccggaagagtattcgccgccgcaggtgctggttgataccgatcggttccttgagatgaatcgtcaacgctcccttgatgatggctttatgcacgcagtgtttaacccgtcatttaacgctctggcaaccgcaatggcgaccgcgcgtcaccgcgccagtaaggtgctggaaatcgcccgtgaccgccacgttgaacaggcgctgaacgagacgccagagaagctgaatcgcgatcgtcgcctggtgctgctaagcgatccggtgacgatggcccgtctgcatttccgtgtctggaattccccggagagatattcttcatgggtgagttattacgaagggataaagctcaatccactggcattgcgtaaaccggatgcggcttcgcaataaaaacgtagttgcctgatgcgctacgcttatcaggcctacatcgttcctgcaatttattgattttgcaagactttgtgggtcggataaggcgttcacgccgcatccggcaaaaacaacgagccaataaaaataccggcgttatgccggtatttttttacgaaagaggtatcaaatgcgtttaattgtggtgagcatcatggtgaccttgctgagtggctgtggcagcattattagtcgcactataccggggcaggggcatggcaaccaatattatcccggtgtgcaatgggatgtgcgtgactccgcctggcgttatgtcacgatccttgatctgccattctctctggtttttgatactttactgctgccgatcgacattcatcatggcccgtatgagtgattaacgttcatcccactcatcagctgctgcgcgtccttcctcggtatccagcggtggctcaagctgaaattccccctcgtcccattcatgtaatgtattctcttcctgccactcctggcgtatctctatctcatcatagtcgccatcaaaaacactttgcgcggcttcaccgctaagcataggtaaacattcaccttcttccccttcgtcggcaaaaaactcaacttgccacatgatgtcgccgtcctgcaaaacgtatttttgggcattgaactgttgcacattcgcatcttcggcgtcgatgccggggttgtctgcaagaaattcttcgcgtgcagcgtcaatggcttcttcaagcgttgcgtacatggtcatcacgattctccctttgagttgatgaggtttcagggaaaaggatagctgattctccgcttttgcaagtatgaaaggcgaaaaatcagttcgatacctggggtattcgacgacgacgtagactgttccatgaatagactgcgttgaataacactacgccagcggtgacgagaaataccgctctgaaaccgtagttcgctgaaatcgctgctcccatcaatggtccggtaacgttgccaatatcacgaaacgattggttatagctgaagatacgcccggcgatctggttgctcgagttgtaaaccaacagtgtctgtacggcggggagtagtgcaccatcggcggcaccgagcaaaaaacgtaaaatcccaagttgcaatggcgtctgaacgtaagacattgggatcaacagcagtacagaaaagatcagcgctgtaatcaggatcttttcgggtccgattcgatcgccaagtttgccgagtcgtggtgcacttagcagagccgccacgcctggcaccgaggcgatcatgccactgataaaggcgacgttactgacgttacccgccagttcgcggacatacagcgtcagaatgggggcaattgagcccgtcgccacctggatgattaacgtagtgacaaacaggctgagtaccagtttcgggtttttaagtgatgtcaccacttcccgcatgtgcagcatctcttttttgctgaccggctggaatttttctctgatgcaaaacagggtgacgaaaaagcagagtatgagcacactggcggtaataaagaataccggacgtaagccgtagctatcggcgagcaggccgccagccattgggccgagcaacgcaccactaacgccgcctgtggagagcgtacccagcgcccagccgcttttattacgcggtacttgtgtggcgataagagcattagcgttggggacaaatccgccaagtaacccaagaagcgcccgcaggatcaaaaactgccagatattttgtgccagccccatcaacaccatcacgatgcccatgccgagggcagagcgtaatagcatgagttttcggcctttacggtcggcgagtccaccccaaaacggtgaggcgatggccgaaaataaaaatgtaatgctgaagacaataccggaccacatattcagggcggagtgaccggtaacgccaagctgctcaacgtagaggggtaagaagggcattaccagactgaaggcggcaccggtaagaaaacagcctagccaggcgacgatcaggtttcgtttccagtttataggggtgtcattttcacagggtgacatagcaatccgctgttggtgcgccaggcgcggtgaacataagaagaaaagataagcacactaattatgcgcccgacttccagggggcgcaatccagagagcttttatcgctaaatcagggggatttgctgtggtaatgccggatgccattctgaagcatccggcatgggagatttaatagcgtgaaggaacgccttccgggcgtgttttaaagcgacggtgtaaccacatatactgctctggtgccatcatgatgcatttttcgaccactttgttcatccacgcggcggtagtttcggcatcatccagtggcggagaacactctggcggcagcataatcaattgataccctttgccatctggcttacggcgtggaacgaagggcaccagacatgcgccggacatccgtgccagcatccaggttccggtcgtggtcgcagcctgctcaacggcaaacaacgggacgaaaacgcttgagcgcgggccgtaatcatgatccggtgcgtaccagaccacttcgccttttttcagggctttaatcatgccttttaaatctttgcggtcgagcatcgatttatttgagcgcaaacggccccaggtttgtagccagtcaatcagtggattatcgttcgggcgataaacgccaatacccggttcctgcataccaaactgccgcgcacccagctccagtgtcagaaaatggatgccaactaacaggatgccgcgtttttgcgcctgcacgtcacgaatgtgttccatgccgatcacttccgtccagcgggcgattcggcggtccggccagaaccacgccatgccggtttccatcaggcccatgccaacggattcgaaattcttcaccaccattttacggcgttcttgttcgctcatttccgggaagcacagttccaggttgcgatgcacaatttttgcgcgtcgtttcataaaacgtaacgccagttttcctaatccacaaccgaggcggtagataaccgggtagggcaattgcacgactaaccaaagtacgccaatacccaaccaggttaaccaataacgcggatgaagcagtgcggtggagaacttgggtagattcgtcatatcaatcctgtttttcaacctattcgggcaattgtatgtattgtcgcattttttcgcccgcaaccaaaatttgtggctgaagactgggcgaaattgccgcgcttgtaaataacaaataatttttaatgcgcaaatgtagcgtaaaatgtgtggatgttaattatcgataattgctatatcatgccgcggatttttactttcccatctcgcaggaaccgtacaccatgccagtgttacacaaccgcatttccaacgacgcgctaaaagccaaaatgttggctgagagcgaaccgcgaaccaccatttcgttttacaagtatttccacatcgccgatcctaaggcgacccgtgacgctttatatcagctgtttaccgcgctgaatgtttttgggcgagtgtatctggcgcatgagggcattaacgcgcaaatcagcgtacctgcgagcaatgttgaaacatttcgcgcgcagctctatgccttcgacccggctttagagggtttacgcctgaatatcgcgttggatgatgacgggaaatccttctgggtactgcgcatgaaggtacgcgatcgcattgttgccgacggtattgacgatcctcactttgatgccagcaatgttggtgagtatctgcaagcggcggaagtgaacgccatgcttgacgatcccgatgcactatttatcgacatgcgtaaccactatgagtatgaagtggggcactttgaaaacgcgctcgaaattccggcagataccttccgtgagcagctgccaaaagcagtcgagatgatgcaggcacataaagataaaaaaatcgtcatgtactgcaccggcggcattcgttgtgaaaaggccagtgcctggatgaaacataacggattcaacaaagtctggcatatcgagggcggaattattgaatacgcccgtaaggcgcgcgagcagggcttgccggtgcgttttattggcaaaaattttgtttttgacgagcggatgggcgaacgtatatcggatgagattatcgcgcattgccaccagtgcggcgcgccgtgcgacagccataccaactgtaaaaatgatggctgccacctgctgtttattcagtgtccagtatgcgcggaaaaatacaaaggttgttgtagtgagatttgctgcgaagaaagcgcgttaccgccagaagaacagcgacgccgtcgggcaggacgtgaaaatggcaataagatctttaataagtctcgtggacgtctgaatacaacactgtgcattcctgatccaacagaataaatatcattgccggatgcgtgccatccggcaacatttcacgcttacttctgctgtacgccttccactgaaataatcagatccacttcctgagaagctggacctaaatctgtcttgatattgaagtccttgagcttaattttgccttcggcctcgaagcctgcacgtttaccaccccatgggtcgtcgccctgaccaattaatttcgcttccagcgtgacgggtttggttacgccattcagcgtcagatcgccggtaatatccagttcgtcaccgtctttcttcacgctggtggaggtgaatgttgcctgtggatattttgcggtattgaggaaatctgcactgcgaagatgtttatcgcgttcggcgtgattagtatcgacgctggtggtgttaattgtcacattcactttatcggcagccggatttttttcgtcaaaggtaaaagtaccgtcgaaatctttaaaggtgccgtataaccagctatagccaaggtgctggatgcggaaattaacaaaggcgtgctgaccttctttgtcaattttgtaatcggcggcaaccgctgaaccggcagagaacatcagggacgcgaaggttaaaccaagcaggctttttttcattttttatactccatagtcagatgacgactttcccagcatgcgcttcagagtgtcgtctttatcgatgaaatgatgcttcagggccataaatccgtgcataacggacagtactacgacgctccacgcgagccaaaaatgcagggcaccggcaaagtctgcctgtgcgccagcgtcggcaagggtcgcggggacgtcaaaccagccaaaaacgctgatcggtttaccatcggcagttgagatcagatagccgctgatgccgatggcgaaaagcaataggtacaatgcgagatgtccagctcttgcggcaagacgagtcatgggcgaataactcggcagcggacccggcggtggagatatgacacgccacagaacgcgaataaccagccccatcattaacaaaataccgatgcttttatgcagttcgggtgctttgtgataccagccatcgtaataactgagcgtgaccatccacagacctaaagcaaacatgccgtagacaataattgcgcttagccaatggaaggccgcagatataacaccatagcgttcaggggtatttgtgaatgacataagtgcatccaaaacgaatttgcgagagaaagaaaatggcgtgtcggagaatgaattgcaacacaaaaataacaaattgaatgatatttatttttatttcaataattttgaattaataatgaaagaatcttcataagtttagtgggttcagcatcagagatgtctggtgagtgctgtagaagcaggaataatctcattcaatttttcacgctaaatgaaagggagattaaatatttgtcagtttatgtcagtgcggaaaactaaaaataaaacacatagatcagatccataattgccaacaatccccagagaaaaagataaagcatcagatgctcgcgaatattattgatgagatagtgcaacagccgacgcattaaatactcctgtaaaaacggcctcattctggaggccgtaatgatgattattggaagcgggaaagcctgaatggcgtcaaatcaaaatcgctttttttgtcttgcgcaaaatcggcagctatttcccctaaaactgacgcaaatttaaaaccgtgcccactcaggccggtaatgagcagtgtattatcgtggccgggtagggtatcgataataaaatcttcgtcaggcgaattatcataggtgcaggcagcgccgtacaggcagcaaccgatacccggcaatacattgcgcaagaacgggaaggcttctgacccatcactggccacttccgcaaacggaacacgttcatccgctgaatggataacctggcctccgttatgtttgccaatcttcaacgcgtcgttttctgccggaaaaccataatattgatcgccattgggcagttcaccggtaaacgccgggaatttattcttcacgctatagcggccatcggcctgataccaggcaaatactttgcgtacgggctggacaggcagctccgggagcaggtcttttacccatgttcccgcgcagacaatcgcttttttcgcctgatactcaccgtcagccgtttcaatagttacgccatcatcgtcatgacgaattgcggtgaccgggcagttgaacagttgcgcacagcccgcttccttcgccagttggatccaggttttaatcgccagttcgctgcgcaaaaaaccggaatcagtttcaaataagccgatgtagttgtccgggacgcgtatttccggccagcgggccataatcccttgcgcatcgagcttttcaacgttgagttgccattgttcggcgctgtgggcgacgttggcgagaaatgtggaatcagccgggccaaggttaatgacgccagagcgtacaaaaatgggatcttcttcgttgtggcgggagagttcatcccacagcgtttgcgcgcggaggaccagcgggacatacttttcgccttcaccataagcatggcgaattaatcgcgtatcgccgtggtggctgccgtgttgatgcggtggcatatgggcgtcggtcattagcacgtttaaaccggcgcgggttgcataatacccggcggcagcgcctacggaaccgctgccaataatgatgagatcgtatttcatttttttctctctgctctcatggtttaagcagagtaattaactgaatgcagatatacaacccagaaatggtaaaggcaccggtgaggtgccttttgggtggatggtcatgtcatgttaatgacgccgatactcgtttacctggaaatcaccggattcaattttggcgattcctgcttctaatatcgaaataaattgtctggcaacatcagtggttaaccagagcgtctgaccaacttcagtcccttcctgctcggacttatttggggtctggtagtgcaaacgcaacatcagcgcatcatagctatcaacggtgctgatgtcccaccctacgagcggatgagtctgaatgacttcattatttttttccatcatggccccctaattcgtgttactagacaacgttattcgaggttcaatgcgtttttatctgaagcaacttcagtataccaataagtaagggtattcaccgaatttttaaagggggaaacagataaatttctgcttttaagatttatatgaacaataaaacagcatgtcattcatatttttttagcatattgtgcaattattttgaggaagtgtagaaattttgtactcaaaattcgtaagtaaaataaaaaagccggggcgacccggcaaaaaaaatcactgcatattattcgctgacaaaccagtcatcggcgctttcccacgtttcctggagaatttcactaatgcgctgtttatcttcttttgtcgcgccaataaccgataaattattcgctgcggcataacgtaccgatacgtggccttcattatcaggaaacgcatactgaatacggcgggaaagttcgccagccagggcgtcaatagccccagctggcaatggagaagttttcgctatggtgacttcaattcgcataatagccccctgttgaatatactggttatttatacaggtaaaataacctaatgacaacaggaagctacgatttttattgtttaacggaccagcgtaccgtttccccggcgaggaatggcaccagcgtgtcatcagtcagtgcgatgctttcagcaacctgttgctcttcacgtaccagttcgatgaatgtgtcgttgaccggcaacccatagaactgcgggccgtttacagaacagaatgcttcaaagtgctgcaaagcattcatttcttcaaagacggtagcgtaactgcccagcgcggttggggcgttgaagcagcccgcgcagccgcaactgctctctttgcgatgacgtgcatgtggcgcagaatccgtaccgaggaatactcgattaaaaccgctggcgaccagttcacgcaatgcctgttggtgaatattacgtttgaggatgggtagacaatacaggtgcggacgcacgcctccaaccagcatatggttgcggttaaacatcagatgctgcggagtgatggtggcagccagccgttcatttccgtcacggacatagtcggcagcatctttggtggtgatgtgctcaaaaacgactttcagcgcagtcaggcgctggcgcagaggttccatcacgctttctataaagcgcgcttcacgatcaaaaatgtcgatatctgcatgtgtcacttcaccatgcaccagtagcggcataccgattttttccatgcgctcaagtaccggcatgattgcgtcaattgacgtcacgccgtggctggagttagtggttgcgtttgccgggtaaagttttgcagcggtgaacacgccttcgttaaatccgcgctccagctcattaggatccagcgaatctgttaaataacaggtcatcaatggggtgaaatcgtgcccggcaggtacggcgtcaagaatacgctggcgatacgccacggcagcctcaacggtggtcacgggcggagccagattgggcattacgatagcccgtccataaatttcgctggtatatggcacgacagtttttaacatgtcgccatcgcggaggtgaaggtgccagtcgtctgggcggcggatctttaatacctgggatggtgcagtcattaatctctatgctccggctgaagggatgtttttgccggacacaaaggataagcggaaacgttttcctttgcacgaaaaataaagggcgcgaatgcgccctcgtgattaatcagtaaatggaatgacaatttcgcctggcttcacttcaatgcctttcgccagttttttcgccattgcttcgccctggctgccatcttcgcgcaggacgtaagcaggttgctggttaaagtaattgcgtaatgcctggttcaaatagggaagcaacgtttgcatcaccgtttgcattttttccggttgtaccgtcgcatcgaccacttccatctctttcaggaagatcgcacctttttctttatcaaacacgggcagcgctttcagcttcagtttcatggtcgctttctgactaccgaacagggagttcatgtccagattggcgtctccggttagggtaaccttattcggctcttcgcgaccaatttggctggtcaggtttgtcagaacaatatgggcgtcagccacgccgggtaaaccgatatcttttgagaaattattatgtttcgcaagcgactggttaatttcttgttcggtgatggtgtattgggtgagttgattacagccaacgagcaggccactgacgatcaatgcagcggcaaataaaaacttgttcatggtagtcctcgacatgaaatctgcgtcaatatcctgacacaacgcagcatgtgtcaccagcgataaactcgccagcagaaaaaactgaaaacggcggcaacccgcgaatacaggctgccgcggcgggtcaggattaaatcgccattgatgataacaaattgatttgtgtctgtttcgccatattatcgcggtaatcagcaacgcggcttggccagttaattccggctaccagcgtcagattacgcagtagcgggaatagctgaatatcatcttccgaaagttcgccattcacggcgttcggtttgacgatcagtttgtccagcgcacgtaaatcatcgctgatattcttaatcagaccgtcagagtgggccagcaggtcggcaaaattacccgcgctggcctctttcttgtcgacgaaatatttgcgcgcggcgggagtagaaaactcatcaaatgccgatttggcaaaacgcggcaacagcagtttgttggcgtagccattgaccttgcgcagccactcttcaatggcaggggaacgtttgccggtcagtaacggtttgccgtcgagtttatcgacatagtgaacgatgtccatgctttctggcatatagcggctgtcatctttttgcagaatgggaacctgtttttgaccgaccatccgggtgggtgtttctgcgtcgtcgttgagcagaacatgtaattcgacggggatatttttcaggccgaaaatcatgcgggctttgaggcagtaagggcagtgatcgtaaatgtatagcttcacgtgactcctccatttggctgtcagttcactttcagtatgaaggagtcaggggggagtatcaaatcaggcgtcgcgttcaagcaaacgacgcgcggcgcgtttctggctaaactgccaacccagcgcaaggaaagtgaagatgccaataatgcccagcatcatccacggaagctctggctggtgcgccgatttgcccaggtcaaacagccagccgccaccgatataaccaatagcgccgccaatcgccagacccagacggctaaaccccatatagctgccgcgagctcttgcgtccgccagcgaagcacttaaggtttcacgcgcaggctcggcaatgatcgacccgatataaaacagacaaatcagggtgaaaagttgttgcaggccgctgaccatgcccaccggcatcatgcttaatgacattatcaacagcccagccatcaaccggtgttccagacgaaaatgcttttcactccagcgggcgatagggtagagcaacgttaacgacagacacgcttcaatggcatacatccatttaacggcagagggcgcgccagccacgtcgttgaccataattggcagcatcagcatcacttgtacagccagcatgtagtaacccgccagcgtcagaacataggtgacaaaacgcttgtcacgcatcacgcgggtcatgccttcgcgaacgggcgtgcgtacggtggagagtttccatgctggtaacaaccacgcattgaacgccgcacatagcacaaatagaactgcccctgtggcgcagaccaggcgaaagtcgtattgcaacagccagctccccaacaatgcgccaatgaccgcaccggcactgtcctgcatcatcaacagcgagaaaaaacgaccacgctgctgtggacggattaatttcaccaccagcgccgaacgcggcggatcaaacaacgtgccaccgagtcccgagagcaggcatgaaaaccacaatagccacggttcgtgggcgatacccattgtggcgaatccggcggcgcgcatcagcataccggtaacaatcatcggtttggcaccaaagcggtcggcaattgcaccgccgaaaatacccagaccttgctgaataaattggcgtagaccgagagcaataccgaccatgacggcggcccagcccatttgatcaacgaagcggatagagatcagcgggaagacaacaaagaaccccagcacgaccagcatattatcgatgagcaggaaatatttacccaggttcctcgcctgcgacacgcgggacatttcccctcccgggaaataaaagatgagcactttctattctgcattgccgctaagacttttcccatcacttcggggacaatatttttttatcaaaacgtcgctttgatagagagtttttatcaaatatgtgaataatgcagaaaatggcattttggacttttcacagggtctggttgcgcaggtatagtaatacttacagcgtattaaagacgttacgggaaggagtaggtatagaatgtttggctatcgcagtaacgtgccaaaagtgcgcttaaccacagaccgactggtcgtgcgtctggtgcatgatcgtgatgcctggcgtcttgcggattattacgcagagaatcgccatttcctcaagccctgggagccagtgcgcgacgaaagccactgttatccatcaggctggcaggccaggctggggatgattaacgaatttcataaacaaggttcagctttctactttggcttattcgacccggacgaaaaagagattattggcgttgccaatttttccaatgttgttcgtggctcttttcatgcctgctatctcggttattcgattgggcaaaaatggcagggcaaaggactcatgtttgaagccctgaccgcagccattcgttatatgcagcgcacccaacatattcatcgcattatggctaattatatgccgcacaataaacgcagcggtgatttactggcgcgactgggttttgaaaaagaaggctatgcgaaagactatctgttgattgatggacaatggcgcgatcacgtactgacggcattaactaccccagactggacgcccggccgctaaggagaatctcatgaaatatcaacttactgcccttgaagctcgcgtgattggttgcttgctggaaaagcaggtgaccacgccggagcaatacccgctctcagtcaatggtgtagtcacggcctgtaatcagaaaacgaaccgtgaaccggtcatgaatctgagtgaatccgaagtgcaggaacagctggataatctggtcaaacgtcattatctacgcacagtgagcggttttggtaatcgggtcaccaaatatgagcaacgtttttgtaattcagaatttggcgatctgaaactgagcgcagcggaagtggcgttaatcaccacgttgttattgcgtggtgcccagacgccaggtgaactgcgcagccgcgccgcgcgaatgtatgaattcagcgatatggcggaagtggagtcgacgctggaacaactggcaaatcgcgaagatggtccttttgtggtgcgtctggcccgcgaaccgggtaaacgcgaaaaccgctacatgcatcttttcagtggtgaggttgaagatcagccggcggtgacggatatgtcgaacgcggttgacggtgatttacaggcccgcgtcgaagccctggaaatcgaagtggcagaactgaaacagcgtcttgattcgttgctggcccatctgggagattaaagtgaaaaaattacgtatcggcgtagtgggattaggtggcattgcgcaaaaagcgtggttaccggtgctggcggcagcgtctgactggacgttacaaggagcctggtcgcctacgcgcgcgaaagccctgccaatttgtgaaagctggcgcattccttatgccgattcgttatccagccttgccgccagttgcgatgcggtttttgtgcattccagcaccgccagccactttgacgtggtcagtacgttactcaatgcgggggtacatgtctgtgtcgataaaccgctggcagaaaatctgcgcgatgctgaacggctggtggaactggcggcgcggaaaaaactgacgttgatggtcggttttaaccgtcgtttcgcaccactctacggtgagttaaaaacgcaactcgccaccgcagcctcgctaagaatggataaacatcgtagcaatagcgtcgggccacacgatctttatttcacgttgctggatgattatctgcatgtggtggataccgcgctgtggttgtcgggcggcaaagcctctctggatggcggtacgctactgactaacgacgctggcgaaatgctgtttgccgagcaccatttttcggctggtcctttgcagatcaccacctgtatgcatcgccgtgccggaagtcagcgtgaaaccgtgcaggccgtgactgacggtgcgctcatcgacattacggatatgcgcgaatggcgtgaggagcgcgggcagggcgtagtgcataaaccgattcctggttggcagagtacgcttgagcaacgtgggtttgtcggctgtgcgcggcacttcattgaatgtgtgcaaaaccagacagttccgcaaaccgccggcgaacaggccgtgctggcgcaacgtatcgttgacaagatctggcgcgatgcgatgagtgaataaaccctgtaacatctggcggtagcaattcaccataatccaggtagactattcgcctctttcagcgcctgccttgcaggcgttttgcccgtgggtctggattagaacaccgatgaatttattaaaatcgctggccgccgtcagctcgatgaccatgttttcgcgtgtgcttggcttcgcacgagacgcaattgtcgccagaatctttggcgcagggatggcaaccgacgcctttttcgtcgcttttaaacttcctaacttgttacgccgtatctttgccgaaggggcattttcccaggcatttgtaccgattctggcggaatataaaagtaagcagggtgaagacgccacgcgggtctttgtctcttatgtttctggcctgctgacacttgcgctggcggttgtgacggtcgctggcatgctcgccgcaccgtgggtgatcatggtgaccgcgccaggcttcgctgacacagctgacaaatttgccctgaccagccagctactaaagattacctttccctatatcttgctgatctccctggcgtcgctggtgggagcgattctgaatacgtggaaccgcttctcgattccggcgtttgctccaacactgcttaacatcagcatgattggtttcgcgctgtttgccgcaccgtactttaacccaccggtgctggcgctggcgtgggctgttacggtcggcggcgtcctgcagctggtgtatcagctaccgcacctgaagaagatcggcatgctggtcctgccgcgcattaacttccacgatgccggagcaatgcgcgtggtgaaacagatgggaccggcgatccttggcgtctctgtgagccagatctccttaatcatcaacaccatttttgcctcgtttcttgcttccggttcggtgtcttggatgtattacgccgaccgcttaatggagtttccgtccggtgtgctgggcgtggcgcttggcaccattttgctgccgtcgctgtcgaaaagttttgccagtggcaatcatgatgaatacaaccgtttgatggactgggggttgcgtctttgtttcctgttggcgctgccgagtgcggttgcgttgggcattctttccggtccgttgaccgtttcgctgttccagtacggtaaatttaccgcgtttgatgcgctgatgacccagcgggcgttaattgcctactcggtgggtttgattggcctgattgtagtgaaagtgttggctcctggcttttattcccgccaggacattaaaacgccagtgaaaattgccatcgttacgctgattttaacgcaattgatgaacctggcgtttattggtccgttgaaacatgccgggctgtcactttctattggtctggcggcgtgtctgaatgcttcgctgctttactggcagttgcgtaagcagaaaatctttaccccgcaacccggctggatggcgtttctgttgcgtctggtggtggcggtactggtgatgtctggcgtgcttttaggtatgttacatatcatgccggagtggtcattgggtaccatgccctggcgtttactgcgtttaatggcggtcgtgctggcggggattgccgcgtacttcgctgcactggcggtactgggcttcaaagttaaagaatttgcccgccggacggtgtaacaatgcattccggcctgcagtgcaggccggagataatcttcagatcgaaatctttttaccgccgcgatgggttgttgaggtctgaccgttcgccccatatagcgtcggttcctgatgcggtttcaacatttccagcgcctgttgattgcgctcaatctgtccttccagtaaccagccgttatgttgattcatttggcgtagttgctgcgttttcacagtaatttcctgccagcgttgactaatatcaacgctatttgctgtattgggttctttcctgcgtaactgttcgaggtaatccagcgtcgccagcagtgagcttttttgttctgtaatccattgcaactggctgccgttgatctgccccatagagagatgttgctgctcttgatccattaccgttttgagatcgttaagcacagcggacatctggtcgaggatctctgcaagacgtgtcatacgatcagttactctgcaagtcttgctgcgcttcgttgatcagcgcatcggcaattttgccggtgtccatttttagttcaccgttacgaatcgccagttttaacgcttcgacacgttcaagattgatatcactgctgccgggttgcatcagttttgcttgcgcgtcgcttaacgtcacactggtgctggtggaggcggttgtttttgccgcccggctgttcgttaccggcgcgtcagtggtttcgcgcggttgaacggtgcttacaggcttcagaggcgaagtgcgatcaatactcatggtttattcctcattgagggcgcttttatcatgtgttgcttatttatcggcaagggacgggtaatctttaacagcttacaggtttataagaatattcccatctgcatcaacaacgccgctgactacctgtcccgataccatgcgcacccgcgcattctgtgcgacggctgcattgttcagcgcctgaccttctgcgttggcgctaaacccatcaccgctggcgatcacattgacgcgttgtcccgcttttacccgccatgcctggcgaaactgggttaactggataggttgatcgggtgatagatcgcgcaggctaatggcatcaacaagttgattgatatccagcaccgtacgcggtggcagggtatccagccgtccgcgtttcagtttgacattgccagcttccagctttcctccccgcgcaatgggcatcgcggcaaccacataatttcctgtggcctgtacattaacctgtaaatatcgtttgtcgttaccgcagcgtgccaacacattcacattgccccacaggcgggaattattgctcatcgaaagcaatggctgctcgcatggcggtagtagattgggcgctgtacgaatagaaacacgaacctcatcacttacccccgcgagttgggcgctaaaaaagttgtgcaattgcgatgtgagattgctcgccgtacttaacggactgaacagtatcgcgatgatcgccacgctacgttttattatcagcattttcgcccccagccatttctacaacgtgaattgtacctgtccgcaatgaccatcaacggcataaatagcgacccattttgcgtttattccgccgataacgcgcgcgtaaaggcatttaagctgatggcagaattttgatacctgcggaggagatatgctcgataagctcgacgccgccttacgttttcaacaagaggcgctcaatctgcgcgcccagcgtcaggaagtgctggcagcaaacatcgccaatgccgatacccctggttatcaggcgcgcgatatcgattttgccagtgaacttaaaaaagtcatgcaacgtggacgggatgcaaccagtgtggttgcactgacgatgacctcaacgcaacacattccggcgcaggcgctgacgcctcctaccgcagaactgcaataccgtattccggaccagccttcgcttgacggtaataccgtcgatatggatcgcgaacgcacccagtttgccgataacagcctgcaataccagatgagccttagcgcgttgagcgggcaaatcaaaggcatgatgaacgttttacagagcggaaattaacggatggcactgctgaatatttttgatatcgccgggtcggcgttaactgcccagtcccagcgcctgaacgtggcggccagtaatctggcgaatgctgatagcgtgaccggtcccgatggacagccatatcgggcaaaacaggtggtattccaggttaacgctgcaccaggtgctgcgacaggcggcgtaaaggttgccgatgttatagaaagtcaggccccggacaaactggtttatgaaccgggtaatccgctggcagatgcaaagggctacgtaaaaatgccgaacgttgatgttgtcggagagatggttaacaccatgtcggcgtcacgcagctatcaggccaatgttgaagtgctcaacacggtgaaaagcatgatgctgaaaacccttacgctcggtcaataaaggagaaagctatgtccattgcggtaaccaccaccgatccgacaaataccggcgtcagtaccaccagcagtagttcgctcacgggcagcaacgccgcagatttacaaagcagttttctgactttgctggtggcgcagctgaaaaaccaggacccgaccaatccaatggaaaacaacgagctgacgtcgcaattggcacaaatcagcacggtcagcgggattgaaaaactcaataccacgctcggatctatttccggacagattgataacagccagtcgttacaggccagtaacctgatcggtcacggcgtgatgatccccggcaccactgttcttgcgggaaccggcagtgaagaaggggctgtgaccacgaccacgccgtttggtgttgagctgcaacaggcggcagacaaagttacggccaccatcaccgataaaaatggcgcggttgtgcgcaccattgatattggtgaactgaccgccggagttcacagtttcacctgggacggtacgttgactgatggcagcactgcgccgaacggttcttacaatgtagcgattagcgccagtaacggtggtacacaactggttgcccagccgctgcagtttgctctggtgcagggtgtgatccgcggcaacagcggtaatacgctggatctcggcacttacggcaccaccaccctcgacgaagtacggcagataatttaagccttcacatttcaggagtcagtcatggccttttctcaagcggttagcggattaaacgctgccgccaccaacctcgatgttattggcaacaatatcgccaactccgccacctacggctttaaatcaggcacggcctcttttgccgatatgtttgccggttcgaaagtgggactgggggtaaaagttgccggtatcactcaggactttaccgatggcacgaccaccaacaccgggcgaggtctggacgttgctatcagccagaacggttttttccgtctggtagacagcaacggttcggtgttctacagccgtaacggacaatttaagctggatgaaaaccgtaacctggtgaatatgcaaggtttacagctgacgggttacccggcaaccggtacgccgccgactattcagcaaggggcgaatccgaccaatatttcgatcccgaataccctgatggcagcgaaaactaccaccacggcatcgatgcagatcaacctgaattccagtgatccgcttcctactgttacgccattcagcgccagcaatgcggatagctataacaaaaaaggttcggtgactgttttcgacagtcagggtaatgctcatgacatgagcgtctactttgtgaagaccggggataataactggcaggtctacacccaggatagcagtgatccaaacagcattgcgaagacagcgacaacactggaatttaatgctaatggcacattagtggatggtgcgatggcgaataatatcgcaaccggcgcaattaacggtgcagaacccgccacgtttagtctgagcttcctcaactccatgcagcaaaataccggcgctaacaatattgtggcaaccacccagaacggctacaaaccgggcgatctggtgagttatcaaatcaatgatgacggtacggttgtcggcaactattccaacgaacaaacccaactgctggggcagattgtactggcgaactttgccaacaacgaaggtctggcatccgaaggcgacaacgtctggtctgcgacgcaatcttctggcgtggcgctgttggggacagccgggacgggaaactttggcaccctgaccaacggtgcgctggaagcgtccaacgtcgatctcagtaaagaactggtcaatatgatcgttgcccagcgtaactatcagtctaacgcccagaccatcaaaacccaggaccagatcctcaacacgctggttaacttacgctaatcgctgacgggatagctcaatggatcacgcaatttataccgcgatgggagcagccagccagacactgaatcaacaggcggtaaccgccagtaatctggccaatgcctcaacgcccggttttcgcgcgcagttgaatgctttacgcgcggtgccagtggaagggctttctctgcccacgcgcacgttggtcacggcgtcaacgccgggcgcagatatgacgcccggcaaaatggattacacctcgcgcccgctggacgtcgcgttgcagcaggatggctggctggccgtgcagaccgctgacggcagcgaagggtatacgcgtaatggcagcattcaggttgatcccaccgggcaactgacaattcaggggcatccggtgataggcgaggctgggccaattgctgtgccggaaggggcggaaatcactattgctgccgatggcacaatctcggcgctcaatccgggcgatccggcaaatacggttgcgccagtagggcgtcttaaactggtgaaagccacgggcagcgaagtgcagcgcggtgacgacggcatttttcgtttaagcgcagaaacccaggccacgcgtgggccggtactgcaggcagatccaaccttgcgtgtgatgtcgggggttctggaaggcagtaacgtcaatgccgttgcggcaatgagcgacatgattgccagcgcgcggcgttttgaaatgcagatgaaggtgatcagcagcgtcgatgataacgcaggccgtgccaaccaactgctgtcgatgagttaattgaaaggatacatgacaagtataagttgcccgatgcgcaagtttatcgggtctatgggggcaatcgcaatttatcgattttgcgagcacttgtaggccggataaggcgtttacgccgcatccggcaagaagacatatgcactttgtcactaatccactacaggacattttatgatcagttcattatggatcgccaaaacgggccttgacgcccagcaaaccaatatggacgtcattgccaacaacctggcaaacgtcagtactaacggttttaagcgtcagcgcgcggtgtttgaagatctgctttatcaaaccattcgccagccgggggcacagtcttccgaacaaaccaccttaccctccggattacaaatcggcacgggggtacgcccggtcgccactgaacgcttacacagccagggaaacctgtcgcagaccaacaacagcaaagatgtcgcgattaaagggcagggctttttccaggtgatgttgccagatggttcatcagcctatacccgtgacggctctttccaggtggatcagaacgggcagctggtgacggctggtggttttcaggtgcagccagcgatcaccattccggcgaatgcgttaagtatcaccatcggtcgtgatggcgtggtcagcgtaacccaacaaggccaggcagctccggttcaggttgggcagctcaatctcaccacctttatgaatgacaccgggctggagagcattggcgaaaacctctacaccgaaacgcaatcctctggtgcaccgaacgaaagcacgccgggcctgaacggcgcgggactgctgtatcaagggtatgttgaaacgtctaacgtcaacgtggcggaagaactggtcaatatgattcaggtgcaacgcgcttacgaaatcaacagtaaagcggtgtccaccaccgatcagatgctgcaaaaactgacgcaactctaaggcttaaccggtggcaggttcaccggtttactgatttttgaagatgatagccatgcaaaaaaacgctgcgcatacttatgccatttccagcttgttggtgctttcactaaccggctgcgcctggataccctccacgccgctggtgcagggggcgaccagtgcacaaccggttcccggtccgacgcccgtcgccaacggttctattttccagtctgctcagccgattaactatggctatcaaccgctgtttgaagatcgtcgaccacgcaatattggcgatacgctgaccatcgtgttgcaggagaacgtcagcgccagcaaaagctcctctgcgaatgccagccgtgacggtaaaactaattttggctttgatactgtgccgcgctatttgcaggggctgtttggtaacgctcgtgccgatgtcgaagcctccggtggtaacacgttcaacggaaagggcggggccaatgccagcaatacctttagcggcacgttgacggtgacggttgaccaggtactggtcaacggcaacctgcatgtggtgggtgaaaaacagattgccattaatcagggtaccgaatttattcgcttctctggcgtggttaatccacgcactatcagcggcagcaataccgtaccgtctactcaggtggcggatgcgcgcattgaatacgtaggcaatggctacattaacgaagcgcaaaatatgggctggttgcagcgtttcttccttaacctgtcgccaatgtaagtgaggctgtggtgattaaatttctctctgcattaattcttctactggtcacgacggcggctcaggctgagcgtattcgcgatctcaccagtgttcagggggtaaggcaaaactcactgattggctatggtctggtggtggggctggatggcaccggtgaccagacaacccagacgccgtttaccacacaaacgcttaataacatgctctcacagctgggaattaccgttccgacgggcaccaatatgcagctaaaaaacgtcgctgcggtaatggtgacagcgtcacttcctccgtttggacgtcaggggcaaaccatcgatgtggtggtttcttccatgggaaatgccaaaagcttgcgtggaggtacgttgttgatgacaccgcttaagggcgttgacagtcaggtgtatgcgctggcgcagggcaatattctggttggcggcgcaggagcctccgctggcggtagcagtgttcaggttaaccaactgaacggtggacggatcaccaatggtgcggttattgaacgtgaattgcccagccagtttggcgtcgggaatacccttaatttgcaacttaacgacgaagatttcagcatggcgcagcaaatcgctgacaccatcaaccgcgtgcgtggatatggcagcgccaccgcgttagatgcgcggactattcaggtgcgcgtaccgagtggcaacagttcccaggtccgcttccttgccgatattcagaatatgcaggttaatgtcaccccgcaggacgctaaagtagtgattaactcgcgcaccggttcggtggtgatgaatcgcgaagtgaccctcgacagctgcgcggtagcgcaggggaatctctcagtaacagttaatcgtcaggccaatgtcagccagccagatacaccgtttggtggtggacagactgtggttactccacaaacgcagatcgatttacgccagagcggcggttcgctgcaaagcgtacgttccagcgccagcctcaataacgtggtgcgcgcgctcaatgcgctgggcgctacgccgatggatctgatgtccatactgcaatcaatgcaaagtgcgggatgtctgcgggcaaaactggaaatcatctgatgatcagcgacagcaaactactggcaagtgcggcctgggatgcgcaatcactcaacgaactaaaggcgaaagcgggcgaagatccggcggcaaatatccgtccggtggcccgtcaggtggaagggatgttcgtgcagatgatgttgaaaagcatgcgcgacgctttaccaaaagatggcctgttcagcagcgagcacactcgcctgtataccagtatgtatgaccagcagattgcccaacagatgacggcgggcaaaggtctggggcttgcagagatgatggttaaacagatgacgccagaacaaccattgccagaggagtccacgccagcagcaccgatgaaattcccgctcgaaactgtggtgcgttatcaaaatcaggcgctttcgcagctggtgcaaaaggccgtgccacgtaactacgatgattcgctgccgggtgacagtaaagcattcctcgcgcaactctcgctgcccgcccaactggcaagccagcaaagcggtgtgccacatcatttgatcctcgctcaggcggcactggaatctggttgggggcaacggcaaatccgccgcgaaaacggcgagccgagctataacctgtttggtgtcaaagcctctggcaactggaaagggccagttactgaaatcaccacgactgaatatgaaaacggcgaagcgaagaaagtaaaagcgaagtttcgcgtctacagctcgtatctggaagccttgtcggattacgttgggctgttaacgcgtaacccgcgctacgccgccgtgacgaccgccgcgagtgcggaacagggggcgcaggccctacaggacgcgggctatgccaccgatcctcactatgcccgcaaactcaccaacatgattcagcagatgaaatcgataagcgacaaggtgagcaaaacctacagtatgaacattgataatctgttctgaataactcaagtccggcgggtcgctgccgataatactctgtaattgaaggcttataaggaacctccatgtccagcttgattaataacgccatgagcggactgaacgcggcccaggcggcgttaaatacggcaagtaataatatctccagctataacgttgccggatatacccgccaaaccactattatggcgcaggccaatagcacgttgggcgctggcggctgggttggcaatggtgtctacgtttctggtgtgcagcgtgagtatgatgcgtttattaccaaccagttacgtgcggcgcagacgcaaagtagcggtctgactgcccgctatgagcagatgtcgaaaatcgacaatatgctctccaccagtacctcttcgctggcaacacagatgcaggatttcttcaccagcctgcaaacgctggtgagtaacgcggaagacccggcagcgcgccaggcgctgattgggaaatcagaaggattggtgaatcagtttaaaaccaccgatcaatatctgcgcgaccaggacaaacaggtcaatatcgcgataggtgccagcgttgatcagatcaacaactacgctaaacaaattgccagcctgaacgatcaaatctcgcgcctgacaggcgtgggggcaggggcgtcacctaacaatctgctggatcaacgcgatcaactggtgagcgaattaaaccagattgttggtgtagaagtcagcgttcaggatggcggcacttataacatcacgatggccaatggttactcactggttcagggaagtacggcgcggcaactggcggcagttccttccagcgctgacccttctcgtacgactgtcgcttatgttgatgggacggcaggcaatattgagatcccggagaaattactgaataccgggtcgctgggcggcattctgacattccgttctcaggatctggaccagacgcgtaatacgcttggacaactggcgctggcatttgccgaggctttcaacacccaacacaaagccggatttgatgctaacggcgatgccggtgaagatttctttgctatcggtaagcccgcggttctgcaaaacacgaaaaacaaaggtgacgttgcgatcggtgccacggtaactgatgcctccgcggtactggcgacagattacaaaatctcgttcgataataatcagtggcaggtcacccgccttgccagcaataccacttttacggtgacgccggatgccaacggtaaagtggcatttgatggtctggagttgacgtttacaggaacgcctgccgttaacgacagcttcacgctgaaaccagtaagtgacgccatcgtcaacatggatgtattaatcaccgacgaagcgaaaatagcgatggcgagcgaagaagatgcgggtgatagcgataaccgcaacggtcaggccctgctggatctgcaaagcaacagtaaaacggtgggcggtgcgaaatcctttaacgacgcttatgcctcgttagtgagtgatatcggtaataaaaccgcgacgttgaaaaccagtagcgccacgcaaggtaatgtggtgacgcagctttccaatcagcagcagtcgatttccggtgtcaatctcgatgaggagtacggaaatctgcaacgttttcagcagtattacctggcgaatgcgcaggttctgcagacggcaaacgcgatttttgatgcgctgattaacattcgctaaggggagataagatgcgtttcagtacacagatgatgtaccagcaaaacatgcgtggtatcaccaattctcaggcagaatggatgaagtacggcgaacagatgtcgacgggtaagcgagtcgttaacccttctgacgatcccattgctgcatcacaagccgtagttctctcccaggcacaggcgcaaaacagccagtacacgctggcgcgtactttcgccactcaaaaagtgtcactggaagagagtgtacttagccaggtcaccactgctatccagaatgctcaggaaaaaattgtctacgccagcaatggcaccttgagtgacgatgaccgggcctcgctggctacggatattcaggggcttcgtgaccagttgctgaatctggcaaacaccactgacggtaacgggcgctacatttttgccggttataaaacagagactgcgccgtttagcgaagagaaagggaaatacgtcggtggagcagaaagtattaaacaacaggtcgatgcttcgcgttcgatggtgatagggcacacgggtgacaaaattttcgacagtattaccagcaacgcggtagcggaaccagacggtagcgcttctgaaaccaatctttttgccatgctggatagtgccatcgcagccctgaaaacgccggtcgcggatagcgaagcggataaagaaaccgccgctgcggcgttagataaaaccaaccgcggactgaaaaactcgctgaacaatgtgctgactgttcgcgcggaattaggcacgcagctgaacgaactggagtcgctggattcattaggtagcgatcgcgctttagggcaaacgcagcagatgagcgatctggttgatgtggactggaatgcaactatttcatcttacatcatgcagcaaacggcattgcaggcatcgtataaagcatttaccgatatgcagggattgtcgctcttccagctcagcaaataatttcgctttaaaacatatcatgaaactgggtatgttttgtctgcctgctctgggatcgctggggcgggcatttttttgcctattttgcattgttggttagcaaggatgccattcgatgaattttaatatgttgattcaaagatgaaataaaaaagccctggcagttaccagggcttgattactttgagctaattattactcaacaggttgcggacgcgcaggagcggcagaggcatgatgtgttgccgtatgaccacctgcggcacctttaccttcgaaggcaaaagtagggcgctgccagtcactgtgacgcggtgcctccggaacatattccggtgctggagcgcgcgtcattggcgcggtagcgtggttatgctcaacggtgacctcaggttcgaccgcagctaccgtttcaacttctgctgcgacttcagcgactactggcgcggcaggttgagcaacaacttcaggttcagcaactacaacctcagcagtttcgacaacttcttcaatatctgccgtctcttcctgcggttcaaccaccggttctgcttgttctgcaacttcctgggctacggcaacatcagactcggtaatcacctgcggctgttcagttaccgcggcagcgatcacttcaggatgcgtcgtttcaaccacttccggttgcggttcggcaacctgaacgggggcttctacgacaccggccacttcttcaacaactggcgcgctaacaaccggttcgatagcggcggcgacagggacctcagtcaccatcggctgcacatgtacttcttcctgttcgcgctgctcttcaacctgtacatcttgcggacgtacaattggatagcggatccagactttgccagaggccagttccggagacgcgcacgctacggtcaacggcattggcgactgggttggataacgctcgtcacgatagcgacgacgacgctgaccacttacgcgcaggtgacgaggcgagcggcgagaacgacgcggcatgccaccgttgtcacggttatcagcattgttctcttcttgctgttctggtgcagtttgcgctacgactggcagcgggactttcaccagttctgtgcgtggagctggcgcttcctgaacaattggttcggcagcgacagtttcttcaaccaccggtgcgactaccgcttcttcggctacgctttgctcgtaacgcactttctgattgagctgacgctgtttacgacgcggctgaaccggacgtacacgttcttcctgttcggtttcctgaacagattgctcttcaacattcagcgccttcgcttcttgttgcgcctgacgtttatcatcattacggcggcggctacgttcacgacgcggcgcttgctgctcgtcggcggtacgcgctttttccgttacctcagcctgctgacggctctcacgcgtctcggcagtctgctgctgtgcctggcgacgattacgacggttttcttcgcgattatcgctgccttcagtacgttcactacgggtgtcgcggcgctcattacggtcacggcggttgttctgacgaggcttgcgacgatcctgttgacgttccggtttcgcttctgctttcggtgctggttgctcggtcggtttggtttcttcaccaccgctgaacagcgctttcagtgcgccgaagaagcggctcaacagcccaggttgtgcaggagctgctggtgttgccggtgcagctttcggtgctggagctacaacaggcgcggcaggttcagctggcgttggcgcaggcggcacatccggcatggcaaaggttgccagcgcaggttgttccggacgcttacgttcagcgaactcttcttcagacggcagcgccatcgcttcttcatgcagcttcggcagcatgtagcttaaggttggggtttcttcccctttacgcacgcgcagcacgtggtagtgcggggtttccatctgatcgtttggcacaattacacagcgcacaccgtcctgacgagtttcaatggcatttaccgcagaacgtttttcattcagcaggtaagaagcgattggcacaggaacaatggcgtgaacttcctgggtgttctctttcagcgcttcttcttcgatcagacgcagaatagagagcgacagcgattcgttgtcacgcacggtgccagtaccagaacaacgcggacaaacgtgatgactggattcacccagtgatgggctcaggcgctgacgggacatttccagcaggccaaagcgagaaatatggctgatttgaatacgcgcacggtcctgacgcaccgcttcacgcagacggttttctaccgcacgctggtggcgtactggcgtcatgtcgatgaagtcgataacaatcaggccgccgaggtcacgcaggcgcagctgacgagcaatctcatcggcagcttcgaggttagtgttaaacgcggtttcttcgatatcgccgccgcgggtcgcgcgtgcggagttgatgtcgatggccgttaacgcttcggtgctgtcgataacaatggaaccaccagacggcagacgaacttcacgctggaaggcggactcgatctgtgactcgatctggtagtggctgaacagcgggatctcgccggtgtacagtttgattttgctgctgaaatccgggcgacctaatgcagcgatatgctgacgtgccagttcgagcactttcgggttatcgataaggatttcgccgatgtcctgacgtaagtaatcgcggaatgcgcgaacgattacgttgctctcctgatgaatcaggaacggggccgggcggctttcagcggcttttttgatggcttcccagtgtttcagacggaagcttaaatcccattgcagcgcctcagcagatttgccgacgccagcggtgcgcacgataagccccatgccttccggcagttcaaggcttgccagtgcttcttttaattcggtacggtcgtcgccttcgatacggcgagaaatgccacccgcgcgcgggttgttcggcatcagaaccagatagctacccgccagactgataaaggtggttaatgccgcgcctttgttgccgcgctcttctttatcgatctgaacaatgacttcctgaccttcacgcaacacatctttaatgttgggacgaccatgagcactgtagttagcagggaaatattcgcgggcaatttcttttagtgggaggaaaccgtgacgttcagcgccgtaatcaacaaaagcagcttccagactcggttcaatgcgggtgattttacctttgtagatgtttgcctttttctgctcgtgccctggactttcgatatccaggtcatacagacgctgcccatctacaagggcaacgcgcaactcttcctgctgagttgcgttgattaacattcttttcatcgtaacttactcattattcttacattgacgactaagctgcgggcaaagtaacgcctttccgggtgtgaaccgatggcctcgtgtctagtcgcgtcgccaacctcacggttatcgtcagctcaaagaggcgcagagtgtcggttgcccgtttttcatgcggaaaaacagcgcaattatcaaagaaacagactgggtattactctccagaaatatttccatctaccggtaaggactgcaacccgcagcccgctaactgcctgaaagatcaatacgtcttacgccattgctgcgtggatgatcggtcgggcaaaatgggttattccgtaaaatttcttgttttaacaaggatggacacggaaacggcctcattattccactgcaagccttgttatagcaagatgacttttaccatttatcacccgcttactcacagttttttcacttcttgctggtgattggtttaataaccatcaataaagtgatcacgcagtgaagtaataaggtgcaaaagtaaatataagcatagaaaaatgagtggcgcgaatcctgttggctaattagaatcgccaaccatgaaaacagagactccatccgtaaaaattgttgctatcaccgctgacgaagcggggcaacgtatcgataactttttgcgtacccaattgaaaggcgtaccaaaaagtatgatttaccgtattttgcgtaaaggcgaagtgcgggtgaacaaaaaacgtattaagcctgaatataaactcgaagcgggtgatgaggtgcgtattccaccggttcgcgttgctgagcgggaagaagaggcggtttcgccacatctgcaaaaggtggcggcgctggcggacgtcatcttatatgaagatgatcacatcctggtgctgaataaaccttccggtacggcggtacatggcggcagtggtttaagcttcggcgttattgaaggtttgcgggcgttgcgcccggaagcgcggttccttgaactggttcatcgtcttgaccgggacacctcaggtgttttgctggtagcgaaaaaacgctcggcgttgcgttctctgcatgagcaattacgtgaaaaagggatgcaaaaagattacctggcgctggtgcgcggtcagtggcagtcgcatgtgaagagcgttcaagcaccgttactgaaaaatattctgcaaagcggcgaacgtatcgtgcgtgtgagtcaggaaggcaaaccgtcggaaacacgctttaaagtggaagaacgctatgcatttgccaccctggtgcgttgtagcccggtaacagggcgtactcaccagatccgtgtgcatacacaatatgcgggtcatccgattgcctttgacgatcgctacggtgaccgtgaatttgacaggcagctcactgaagcaggcacgggattaaatcgcctgttcctgcacgctgcagcgttgaagtttactcatccggggaccggtgaggtgatgcgtatcgaagctccgatggatgaaggtttgaagcgttgtttgcaaaagctgcgtaacgcgcgctaatacaagcatataaacctgataatgggcggttggcctgataaggcgtttacgccgcatcaggccgccagcaccgattgccggatgcgacgtaaccacatccggcgcaaaaaactatcccatcagcgggtttttcccttcccgacgtaacatctgacacagcgcgattagcggtaaaccaaccagcgtgttaggatcacgcccctctaaacgctcaaacagcgtaatgccaaatccttcactcttaaagctacccgcgcagtgcaggggatgctctttacgcacgtaattatcaatctccgcctcgctcaggtgacggaaatggacgtcaaaaggctccacttctgtttgcagatgcccattcgccgaattaaacaacgccagtccagtatagaaggtgacgatattgccgctggctttgcgtaattgcagacgggcattttcttccgttaacggtttaccggtgatttcgccatcaagaacacatacctggtctgaaccaataattaaatgatccggataacgtgacgccagagattgcgctttttcttgtgccagtcgaagcaccaactgtcgcggtgattcgtcgctgcgtggggtttcgtcgacctctggtgctgcacattcaaaagagatttgcagtttttccagaagagcgcgacgccatggcgaggtggaggctaaaataagtttaggcatatttttttccatcagatatagcgtattgatgatagccattttaaactatgcgcttcgttttgcaggttgatgtttgttatcagcactgaacgaaaataaagcagtaacccgcaatgtgtgcgaattattggcaaaaggcaaccacaggctgcctttttctttgactctatgacgttacaaagttaatatgcgcgccctatgcaaaaggtaaaattacccctgactctcgatccggttcgtacggctcaaaaacgccttgattaccagggtatctatacccctgatcaggttgagcgcgtcgccgaatccgtagtcagtgtggacagtgatgtggaatgctccatgtcgttcgctatcgataaccaacgtctcgcagtgttaaacggcgatgcgaaggtgacggtaacgctcgagtgtcagcgttgcgggaagccgtttactcatcaggtctacacaacgtattgttttagtcctgtgcgttcagacgaacaggctgaagcactgccggaagcgtatgaaccgattgaggttaacgaattcggtgaaatcgatctgcttgcaatggttgaagatgaaatcatcctcgccttgccggtagttccggtgcatgattctgaacactgtgaagtgtccgaagcggacatggtctttggtgaactgcctgaagaagcgcaaaagccaaacccatttgccgtattagccagcttaaagcgtaagtaattggtgctccccgttggatcggggataaaccgtaattgaggagtaaggtccatggccgtacaacagaataaaccaacccgttccaaacgtggcatgcgtcgttcccatgacgcgctgaccgcagtcaccagcctgtctgtagacaaaacttctggtgaaaaacacctgcgtcaccacatcactgccgacggttactaccgcggccgcaaggtcatcgctaagtaatcacgcatctgcgtgatgaagcttagtgaggattttccccaggcaactggggaaagaccaaaccgggcggcgacgataccttgacacgtctaaccctggcgttagatgtcatgggaggggattttggcccttccgtgacagtgcctgcagcattgcaggcactgaattctaattcgcaactcactcttcttttagtcggcaattccgacgccatcacgccattacttgctaaagctgactttgaacaacgttcgcgtctgcagattattcctgcgcagtcagttatcgccagtgatgcccggccttcgcaagctatccgcgccagtcgtgggagttcaatgcgcgtggccctggagctggtgaaagaaggtcgagcgcaagcctgtgtcagtgccggtaataccggggcgctgatggggctggcaaaattattactcaagcccctggaggggattgagcgtccggcgctggtgacggtattaccacatcagcaaaagggcaaaacggtggtccttgacttaggggccaacgtcgattgtgacagcacaatgctggtgcaatttgccattatgggctcagttctggctgaagaggtggtggaaattcccaatcctcgcgtggcgttgctcaatattggtgaagaagaagtaaagggtctcgacagtattcgggatgcctcagcggtgcttaaaacaatcccttctatcaattatatcggctatcttgaagccaatgagttgttaactggcaagacagatgtgctggtttgtgacggctttacaggaaatgtcacattaaagacgatggaaggtgttgtcaggatgttcctttctctgctgaaatctcagggtgaagggaaaaaacggtcgtggtggctactgttattaaagcgttggctacaaaagagcctgacgaggcgattcagtcacctcaaccccgaccagtataacggcgcctgtctgttaggattgcgcggcacggtgataaaaagtcatggtgcagccaatcagcgagcttttgcggtcgcgattgaacaggcagtgcaggcggtgcagcgacaagttcctcagcgaattgccgctcgcctggaatctgtatacccagctggttttgagctgctggacggtggcaaaagcggaactctgcggtagcaggacgctgccagcgaactcgcagtttgcaagtgacggtatataaccgaaaagtgactgagcgtacatgtatacgaagattattggtactggcagctatctgcccgaacaagtgcggacaaacgccgatttggaaaaaatggtggacacctctgacgagtggattgtcactcgtaccggtatccgcgaacgccacattgccgcgccaaacgaaaccgtttcaaccatgggctttgaagcggcgacacgcgcaattgagatggcgggcattgagaaagaccagattggcctgatcgttgtggcaacgacttctgctacgcacgctttcccgagcgcagcttgtcagattcaaagcatgttgggcattaaaggttgcccggcatttgacgttgcagcagcctgcgcaggtttcacctatgcattaagcgtagccgatcaatacgtgaaatctggggcggtgaagtatgctctggtcgtcggttccgatgtactggcgcgcacctgcgatccaaccgatcgtgggactattattatttttggcgatggcgcgggcgctgcggtgctggctgcctctgaagagccgggaatcatttccacccatctgcatgccgacggtagttatggtgaattgctgacgctgccaaacgccgaccgcgtgaatccagagaattcaattcatctgacgatggcgggcaacgaagtcttcaaggttgcggtaacggaactggcgcacatcgttgatgagacgctggcggcgaataatcttgaccgttctcaactggactggctggttccgcatcaggctaacctgcgtattatcagtgcaacggcgaaaaaactcggtatgtctatggataatgtcgtggtgacgctggatcgccacggtaatacctctgcggcctctgtcccgtgcgcgctggatgaagctgtacgcgacgggcgcattaagccggggcagttggttctgcttgaagcctttggcggtggattcacctggggctccgcgctggttcgtttctaggataaggattaaaacatgacgcaatttgcatttgtgttccctggacagggttctcaaaccgttggaatgctggctgatatggcggcgagctatccaattgtcgaagaaacgtttgctgaagcttctgcggcgctgggctacgacctgtgggcgctgacccagcaggggccagctgaagaactgaataaaacctggcaaactcagcctgcgctgttgactgcatctgttgcgctgtatcgcgtatggcagcagcagggcggtaaagcaccggcaatgatggccggtcacagcctgggggaatactccgcgctggtttgcgctggtgtgattgatttcgctgatgcggtgcgtctggttgagatgcgcggcaagttcatgcaagaagccgtaccggaaggcacgggcgctatggcggcaatcatcggtctggatgatgcgtctattgcgaaagcgtgtgaagaagctgcagaaggtcaggtcgtttctccggtaaactttaactctccgggacaggtggttattgccggtcataaagaagcggttgagcgtgctggcgctgcctgtaaagcggcgggcgcaaaacgcgcgctgccgttaccagtgagcgtaccgtctcactgtgcgctgatgaaaccagcagccgacaaactggcagtagaattagcgaaaatcacctttaacgcaccaacagttcctgttgtgaataacgttgatgtgaaatgcgaaaccaatggtgatgccatccgtgacgcactggtacgtcagttgtataacccggttcagtggacgaagtctgttgagtacatggcagcgcaaggcgtagaacatctctatgaagtcggcccgggcaaagtgcttactggcctgacgaaacgcattgtcgacaccctgaccgcctcggcgctgaacgaaccttcagcgatggcagcggcgctcgagctttaaaagaggaaaatcatgaattttgaaggaaaaatcgcactggtaaccggtgcaagccgcggaattggccgcgcaattgctgaaacgctcgcagcccgtggcgcgaaagttattggcactgcgaccagtgaaaatggcgctcaggcgatcagtgattatttaggtgccaacggcaaaggtctgatgttgaatgtgaccgacccggcatctatcgaatctgttctggaaaaaattcgcgcagaatttggtgaagtggatatcctggtcaataatgccggtatcactcgtgataacctgttaatgcgaatgaaagatgaagagtggaacgatattatcgaaaccaacctttcatctgttttccgtctgtcaaaagcggtaatgcgcgctatgatgaaaaagcgtcatggtcgtattatcactatcggttctgtggttggtaccatgggaaatggcggtcaggccaactacgctgcggcgaaagcgggcttgatcggcttcagtaaatcactggcgcgcgaagttgcgtcacgcggtattactgtaaacgttgttgctccgggctttattgaaacggacatgacacgtgcgctgagcgatgaccagcgtgcgggtatcctggcgcaggttcctgcgggtcgcctcggcggcgcacaggaaatcgccaacgcggttgcattcctggcatccgacgaagcagcttacatcacgggtgaaactttgcatgtgaacggcgggatgtacatggtctgaccgcgatttgcacaaaatgctcatgttgcgcgcagtctgcgtggttatgagtaataattagtgcaaaatgatttgcgttattggggggtaaggcctcaaaataacgtaaaatcgtggtaagacctgccgggatttagttgcaaatttttcaacattttatacactacgaaaaccatcgcgaaagcgagttttgataggaaatttaagagtatgagcactatcgaagaacgcgttaagaaaattatcggcgaacagctgggcgttaagcaggaagaagttaccaacaatgcttctttcgttgaagacctgggcgcggattctcttgacaccgttgagctggtaatggctctggaagaagagtttgatactgagattccggacgaagaagctgagaaaatcaccaccgttcaggctgccattgattacatcaacggccaccaggcgtaagtgaacatctccaggcggtcgttcgaccgcctgagttttatctttttgtcccactagaatcattttttccctccctggaggacaaacgtgtctaagcgtcgtgtagttgtgaccggactgggcatgttgtctcctgtcggcaataccgtagagtctacctggaaagctctgcttgccggtcagagtggcatcagcctaatcgaccatttcgatactagcgcctatgcaacgaaatttgctggcttagtaaaggattttaactgtgaggacattatctcgcgcaaagaacagcgcaagatggatgccttcattcaatatggaattgtcgctggcgttcaggccatgcaggattctggccttgaaataacggaagagaacgcaacccgcattggtgccgcaattggctccgggattggcggcctcggactgatcgaagaaaaccacacatctctgatgaacggtggtccacgtaagatcagcccattcttcgttccgtcaacgattgtgaacatggtggcaggtcatctgactatcatgtatggcctgcgtggcccgagcatctctatcgcgactgcctgtacttccggcgtgcacaacattggccatgctgcgcgtattatcgcgtatggcgatgctgacgtgatggttgcaggtggcgcagagaaagccagtacgccgctgggcgttggtggttttggcgcggcacgtgcattatctacccgcaatgataacccgcaagcggcgagccgcccgtgggataaagagcgtgatggtttcgtactgggcgatggtgccggtatgctggtacttgaagagtacgaacacgcgaaaaaacgcggtgcgaaaatttacgctgaactcgtcggctttggtatgagcagcgatgcttatcatatgacgtcaccgccagaaaatggcgcaggcgcagctctggcgatggcaaatgctctgcgtgatgcaggcattgaagcgagtcagattggctacgttaacgcgcacggtacttctacgccggctggcgataaagctgaagcgcaggcggtgaaaaccatcttcggtgaagctgcaagccgtgtgttggtaagctccacgaaatctatgaccggtcacctgttaggtgcggcgggtgcagtagaatctatctactccatcctggcgctgcgcgatcaggctgttccgccaaccatcaacctggataacccggatgaaggttgcgatctggatttcgtaccgcacgaagcgcgtcaggttagcggaatggaatacactctgtgtaactccttcggcttcggtggcactaatggttctttgatctttaaaaagatctaagttgtcattttccacccttataaaaggtccgcttgcgggccttttttcttagcttttattccgacttgttccgtagtgaacatgctgccacactaacaattctctgataaggagccggtatgttcttaattaacggtcataagcaggaatcgctggcagtaagcgatcgggcaacgcagtttggtgatggttgttttaccaccgccagagttatcgacggtaaagtcagtttgttatcggcgcatatccagcgactacaggatgcttgtcagcggttgatgatttcctgtgacttctggcctcagcttgaacaagagatgaaaacgctggcagcagaacagcaaaatggtgtgctgaaagtcgtgatcagtcgcggtagtggcgggcgagggtacagcacattgaacagcggaccggcaacgcggattctctccgttacggcttatcctgcacattacgaccgtttgcgtaacgaggggattacgttggcgctaagcccggtgcggctggggcgcaatcctcatcttgcaggtattaaacatctcaatcgtcttgagcaagtattgattcgctctcatcttgagcagacaaacgctgatgaggcgctggtccttgacagcgaagggtgggttacggaatgctgtgcggctaatttgttctggcggaagggcaacgtagtttatacgccgcgactggatcaggcaggtgttaacggcattatgcgacaattctgtatccgtttgctggcacaatcctcttatcagcttgtcgaagtgcaagcctctctggaagagtcgttgcaggcagatgagatggttatttgtaatgcgttaatgccagtgatgcccgtatgtgcctgtggcgatgtctccttttcgtcagcaacgttatatgaatatttagccccactttgtgagcgcccgaattagtcatgaaaaaagtgttattgataatcttgttattgctggtggtactgggtatcgccgctggtgtgggcgtctggaaggttcgccatcttgccgacagcaaattgcttatcaaagaagagacgatatttaccctgaagccagggaccggacgtctggcgctcggtgaacagctttatgccgataagatcatcaatcgtccacgggtttttcaatggctgctgcgtatcgaaccggatctttctcactttaaagccgggacttaccgctttacaccgcagatgaccgtgcgcgagatgctgaaattgctggaaagcggtaaagaagcacagttccctctgcgactggtagaagggatgcgtctgagcgattacctcaagcaattgcgtgaggccccgtatatcaagcatacgctgagcgatgataagtacgccaccgtagcgcaggcacttgaactggaaaacccggagtggattgaaggttggttctggccagacacctggatgtataccgccaataccaccgatgtcgcgttactcaagcgagcgcacaagaaaatggtgaaagcggtcgatagcgcctgggaagggcgtgcggacggtctgccttataaagataaaaaccagttggtgacgatggcatcaattatcgaaaaagaaaccgccgttgccagtgaacgcgataaggttgcctcagtatttatcaaccgtttacgcattggtatgcgcctgcagaccgacccgaccgtgatttacgggatgggagagcgttataatggcaaactttctcgtgcagacctggaaacgccgacagcgtataacacctataccattaccggtctgccgccaggtgcgatagcgacgccgggggcggattcgctgaaggctgctgcgcatccggcaaaaacgccgtatctctattttgtggccgatggtaaaggtggtcacacgtttaataccaatcttgccagtcataacaagtctgtgcaggattatctgaaagtgcttaaggaaaaaaatgcgcagtaagtatatcgtcattgaggggctggaaggcgcaggcaaaactaccgcgcgtaatgtggtggttgagacgctcgagcaactgggtatccgcgacatggttttcactcgggaacctggcggtacgcaacttgccgaaaagttaagaagcctggtgctggatatcaaatcggtaggcgatgaagtcattaccgataaagccgaagttctgatgttttatgccgcgcgcgttcaactggtagaaacggtcatcaaaccagctctggctaacggcacctgggtgattggcgatcgccacgatctctccactcaggcgtatcagggcggcggacgtggtattgaccaacatatgctggcaacactgcgtgatgctgttctcggggattttcgccccgacttaacgctctatctcgatgttaccccggaagttggcttaaaacgcgcgcgtgcgcgcggcgagctggatcgtattgagcaagaatctttcgatttctttaatcgcacccgcgcccgctatctggaactggcagcacaagataaaagcattcataccattgatgccacccagccgctggaggccgtgatggatgcaatccgcactaccgtgacccactgggtgaaggagttggacgcatgagatggtatccatggttacgacctgatttcgaaaaactggtagccagctatcaggccggaagaggtcaccatgcgctactcattcaggcgttaccgggcatgggcgatgatgctttaatctacgccctgagccgttatttactctgccaacaaccgcagggccacaaaagttgcggtcactgtcgtggatgtcagttgatgcaggctggcacgcatcccgattactacaccctggctcccgaaaaaggaaaaaatacgctgggcgttgatgcggtacgtgaggtcaccgaaaagctgaatgagcacgcacgcttaggtggtgcgaaagtcgtttgggtaaccgatgctgccttactaaccgacgccgcggctaacgcattgctgaaaacgcttgaagagccaccagcagaaacttggtttttcctggctacccgcgagcctgaacgtttactggcaacattacgtagtcgttgtcggttacattaccttgcgccgccgccggaacagtacgccgtgacctggctttcacgcgaagtgacaatgtcacaggatgcattacttgccgcattgcgcttaagcgccggttcgcctggcgcggcactggcgttgtttcagggagataactggcaggctcgtgaaacattgtgtcaggcgttggcatatagcgtgccatcgggcgactggtattcgctgctagcggcccttaatcatgaacaagctccggcgcgtttacactggctggcaacgttgctgatggatgcgctaaaacgccatcatggtgctgcgcaggtgaccaatgttgatgtgccgggcctggtcgccgaactggcaaaccatctttctccctcgcgcctgcaggctatactgggggatgtttgccacattcgtgaacagttaatgtctgttacaggcatcaaccgcgagcttctcatcaccgatcttttactgcgtattgagcattacctgcaaccgggcgttgtgctaccggttcctcatctttaagagagacatcatgtttttagtcgactcacactgccatctcgatggtctggattatgaatctttgcataaggacgtggatgacgttctggcgaaagccgccgcacgcgatgtgaaattttgtctggcagtcgccacaacattaccgggttatttacatatgcgggatctggtaggcgaacgtgacaacgtcgtattttcttgtggcgtgcatccactcaaccagaatgatccctacgatgtagaagatttacgccgtctggcggcagaagagggtgttgtagcgctgggtgaaaccgggctggattattattacacgccggaaactaaagtacgtcagcaagagtccttcatccatcatatccagattggtcgtgaactgaacaagccggttatcgtccatacccgtgacgcccgtgccgatacgctggcaattctgcgcgaagaaaaagtgacggattgcggtggcgtactacactgttttacagaggacagagaaacggcgggtaaattactggatctcggattttacatctccttttccggcattgtgaccttccgtaatgcggagcaactgcgcgatgctgcgcgttatgtccccctggatcggttactggtggaaactgactcaccttaccttgcgccggtaccgcatcgaggaaaagagaatcaacctgcgatggttcgtgacgttgcagaatacatggctgtgttgaaaggtgttgccgttgaagaactggcgcaggtaaccaccgataacttcgcccgtctgtttcacatcgacgcttcccgccttcaatccatccgttgaatgagtttttttaaagctcgtaattaatggctaaaacgagtaaagttcaccgccgaaaattgggcggtgaataaccacgtttgaaatattgtgacatatgttttgtcaaaatgtgcaacttctccaatgatctgaagttgaaacgtgatagccgtcaaacaaattggcactgaattattttactctgtgtaataaataaagggcgcttagatgccctgtacacggcgaggctctccccccttgccacgcgtgagaacgtaaaaaaagcacccatactcaggagcactctcaattatgtttaagaatgcatttgctaacctgcaaaaggtcggtaaatcgctgatgctgccggtatccgtactgcctatcgcaggtattctgctgggcgtcggttccgcgaatttcagctggctgcccgccgttgtatcgcatgttatggcagaagcaggcggttccgtctttgcaaacatgccactgatttttgcgatcggtgtcgccctcggctttaccaataacgatggcgtatccgcgctggccgcagttgttgcctatggcatcatggttaaaaccatggccgtggttgcgccactggtactgcatttacctgctgaagaaatcgcctctaaacacctggcggatactggcgtactcggagggattatctccggtgcgatcgcagcgtacatgtttaaccgtttctaccgtattaagctgcctgagtatcttggcttctttgccggtaaacgctttgtgccgatcatttctggcctggctgccatctttactggcgttgtgctgtccttcatttggccgccgattggttctgcaatccagaccttctctcagtgggctgcttaccagaacccggtagttgcgtttggcatttacggtttcatcgaacgttgcctggtaccgtttggtctgcaccacatctggaacgtacctttccagatgcagattggtgaatacaccaacgcagcaggtcaggttttccacggcgacattccgcgttatatggcgggtgacccgactgcgggtaaactgtctggtggcttcctgttcaaaatgtacggtctgccagctgccgcaattgctatctggcactctgctaaaccagaaaaccgcgcgaaagtgggcggtattatgatctccgcggcgctgacctcgttcctgaccggtatcaccgagccgatcgagttctccttcatgttcgttgcgccgatcctgtacatcatccacgcgattctggcaggcctggcattcccaatctgtattcttctggggatgcgtgacggtacgtcgttctcgcacggtctgatcgacttcatcgttctgtctggtaacagcagcaaactgtggctgttcccgatcgtcggtatcggttatgcgattgtttactacaccatcttccgcgtgctgattaaagcactggatctgaaaacgccgggtcgtgaagacgcgactgaagatgcaaaagcgacaggtaccagcgaaatggcaccggctctggttgctgcatttggtggtaaagaaaacattactaacctcgacgcatgtattacccgtctgcgcgtcagcgttgctgatgtgtctaaagtggatcaggccggcctgaagaaactgggcgcagcgggcgtagtggttgctggttctggtgttcaggcgattttcggtactaaatccgataacctgaaaaccgagatggatgagtacatccgtaaccactaatccgtaagacgttggggagactaaggcagccagatggctgccttttttacaggtgttattcagaattgatacgtgccggtaatgctgaaattacgcggtgtgccgtagacgatagaaccttccacgttggtatcgtaggttttgtcgaacaggttattgacgttcccctgtaacgagaagtttttcgtcacctggtagcgggtgaagagatccaccagcgcgtagctaccttgctcggcgcggaaggtgccatacggcgtcacggtgtcggtatacacgcgattttgccagttaacaccaccgccgaccgtcaactctggcatgacaggcaaccgatagctggtgaacattttaaccgtggtgcgtggcagattaggattaacggcgtttccttcgttatcctctgcaatatagcgcgttgcgccaaatgtcagctgccagttgtcggtaattgcgccgttgagttcaaattccacccctttactgactgtcccatccaccgctttataggcggtttcgccgttgctgccggggataggtgtaccggtggactgagcgacattatcctgctcaatacggaagatggctaacgtggtggtcagacggctattcatccagtccgatttcagacccagctcgtagttgttaccggtgattggagccagatatttgcctgaactgtcacgatcattttgcggctggaaaatagaggtatagctggcgtaggtcgaccagttgtcattgatgtcaaacaccagaccagcgtaaggcgtggtgtggtttttctccatgctgtaagtcagcgtatcaacccgccagttggtataacgtgcgccgaggatcagatgcagcggatcggcaagggtgacacgagtggcagcatataacgatttcatatgtgtggtatcgtcctgcgccaggctctgtggtgaccagtcggtttgtgggaaattgccattaaagttgtagaaactgccaatttcatccgggaagatgttggcccatgaactgaagtaacgattgttttgtttgctgtaactgccaccaaacattagattgtgctgacgaccaaacaattcataactaccgtcagcgaacaaatccagcgcatcaactttacgtttgccactgttccaaccggtgccgccgacataatcaaagccaggtccataattactgtatggcccaaccagcataccatccgctttgtttacataggcatcgacatacatcattttgctgtcaaattcgacttcagagtgggtggcattcagtgtcgcttgccaggtatcagcaaactgctgcttcagggtcataaagaccttgttgatctctttatcgttgtacgcccagtcaggtgcggtactgcgtgcgcgatcgtaactgttgctgctgccatcagtattccagcgcggtaaaccgccccaggtagggctattaacatcaatgcgctgatattcgtaaccggctgaaagcgtcgtaagatcgcctaaatcagcatcgacaatgcccgagaagaaggtcttttcactgttgtagcggtccagccatgagtcgttattctggtagccgccgacaattcgcgcgcggattttaccgtcttcggtgagtgggctttgtaaatccgccacataccgttctttgttccagctaccgtattccgccgagacatcgcctttaaattcacgactggtcgcgtgttttcgaaccatattaattgccgcagatggattacccgtcccggtcatgagtcctgtcgcgccacgcactacttctacgcgttcaaagagtgccatatcagaaagtgcgtcgcccagattccagcgcgattcaaaataggtggggataccatcaaccatatagttatcgatctggaatccgcgggaataataaagagcacgatcggaatccgcctgacttttgctgatccccagcgtgttttccatcacttcgcccagcgtttgtaactgctgatcttccatccgctgctggctaacaatagtgaccgactgaggaatatcacgttgagtcatctgcattttggtacccgcagaggtagacgttacgctgtaatcattttcgccatcatctggagctgtggctgaaccctcaacaatcaccgtttcttcagtggctggtgcagcaaaagcggcagaaggtaatagtgccagtgctatgcaaccggcaagtagtgacggtttggtgatggcttgatattgattatccctgttaaattgtgttgaaagcatttgaaatctcttggtttatgttgtcgtcaggctcatgccggaggagggtgatgagcgattatatttagtgtgcgaataattttgtttgtaaatgcaaatgagaaatatacgcattcatatttgtcatgtaaaccaaacagagaatgtcttttcagcgcattcgcaggcagaaatgggaataatggcgatatatacggcagcaaaacgattttttgcttaagaaatcgtgagttaaggttgaaagagcaggtttaactcgaccatactctatactcgcagtgtggcgcggcgtagcatggcgcaacgcatggctatttgaaaaaggaaaatgtcgtggcagaagaaactatattcagcaaaattattcgtcgtgagatcccctccgatatcgtctaccaggatgatctggtaacggcgtttcgcgatatttcgccgcaagcgccaacgcatattctgatcattccgaatatcctcattccgactgtgaacgacgtctcagctgagcatgagcaggcgctgggacgcatgatcaccgtagcggcaaaaattgctgagcaagaaggtattgccgaagatggctatcgtctgatcatgaataccaaccgccatggcggacaagaggtttaccacatccatatgcacttgttgggtggccgtccgctgggaccaatgctggcgcataaaggtctgtaacgatgagaaaaggatgctttgggctggtgtctctggtgttgttactgctggtgggctgtcgttcacatccggaaattccggtgaatgatgagcaatcgctggtgatggagtcatctttattggctgcgggcatcagtgcagaaaagcccttcctttcgacgtctgatattcaaccttcagcatcctcaacgctttataacgaaaggcaagaacccgttaccgttcattatcgtttttactggtatgacgccagagggctggagatgcatcctctggaaaggccacgcagcgttaccattcccgcacattcggcggtaacgctgtacggcagcgccaattttctgggggcgcacaaagtcagactttatctatatttgtaaggggtgaatcttgatgacaaaaatgagtcgctacgccttgattaccgcgctggcgatgtttctcgccgggtgtgtggggcaacgtgaacctgcaccggtagaagaagtgaaaccagcgccggaacaaccagccgagccacaacagcctgtccccacagtgccctcggtgccgacgatcccgcagcagccaggcccaattgagcacgaagatcaaactgcaccgcctgcgccgcatattcgccattatgactggaatggcgcaatgcagccgatggtcagtaagatgcttggggctgacggggtgactgcgggtagcgtcctgctggttgatagcgttaacaaccgtactaacggttcgctgaatgccgcagaagcgaccgaaacgctgcgaaatgcgctggctaataacgggaaatttaccctggtttccgcccagcaactgtcgatggcgaagcaacagttaggtttgtcgccgcaggacagtttaggcacccgtagtaaagccataggcattgcccgcaatgtcggcgctcattacgtgctgtactccagcgcctctggcaacgttaacgctccgaccctacaaatgcagctgatgctggtgcagacgggcgaaattatctggtcaggtaaaggtgccgtttcgcagcaataatcccatcacgcgcgacgaattgctgtcgcgctttttcccgcagtatcatcccgtcacgacgtttaatagtgggcttagtggcgggagttttctcattgaacatcagggccagcgttttgttgtgcgtcagccgcacgatcctgatgcgccgcagtccgcgttcttgcgccagtatcgggctttatcacaactacccgcatgcattgcaccgaagccgcatttatatctccgtgactggatggtagtcgactatctgcccggcgcggtaaaaacgtatttgccggataccaacgaactggcaggcttgctgtattatctacatcaacaaccacgttttggctggcgaataacgctgttgccgttactggaactgtactggcagcaaagcgatccggcgcggcggacagtgggttggctgcgaatgttaaaacgtctgcgcaaagcgcgggaaccacggcctttacgcttaagtccattgcatatggatgtccacgccggaaatttagtgcatagcgcgtcagggttaaaactcatcgactgggagtatgccggagatggtgatatcgcgctggaactggcggcggtgtgggtggaaaatactgaacagcaccggcaattggtcaatgactatgccactcgcgcgaagatttatccggcgcaattatggcgtcaggtcaggcgatggtttccctggctgctgatgctcaaagcagggtggtttgagtaccgctggcgacaaaccggcgatcaacaatttatcaggctggccgatgacacctggcggcagctattaataaaacaataaggagagcagtgtgggtccagtaatgttggatgtcgaaggttacgaactggacgcggaagagcgtgaaatactggcgcatccgctggtgggagggctgattctctttacgcgtaactatcatgatcctgcccagttacgtgaactggtgcgccagatccgcgcagcttcgcgcaatcgtctggtggtggcggttgatcaggaaggtggacgcgtgcagcgttttcgtgaaggttttacccgcttgccagcggcgcaatcattcgctgcgctgtcaggaatggaagagggtggcaaactggcgcaggaggcaggttggttgatggccagcgaaatgatcgctatggatattgatatcagctttgcgcctgtgctggatgtcgggcatatcagcgcggcgattggcgagcgttcttatcatgccgatccacaaaaagccctggcaattgccagccggtttattgatggtatgcatgaagccggaatgaaaacgaccgggaaacacttcccaggacacggtgcagtaacggcagactcacacaaagaaacaccgtgcgatccacgtccacaagcggagattcgcgctaaagatatgtcggtcttcagttccttaatccgcgaaaataaactcgacgccattatgcctgcgcatgtgatctacagtgatgttgatccgcgtccggcgagcggttctccctactggctgaaaaccgttttgcgtcaggaactgggttttgacggcgtgattttctctgacgatttatcgatggaaggtgccgcgattatgggcagttatgccgaacgcgggcaggcttcactggatgcgggttgcgatatgatcctggtctgcaataatcgtaaaggggccgtcagcgtgttagataatctgtcaccgatcaaggcagaacgtgttacacgtttgtatcataaaggttcattttcgcgacaggaactgatggactcggctcgctggaaagcgatcagcacccgtctgaatcagttacatgaacgctggcaggaagagaaagcaggtcactaaccctggcttatgtgaggaagcgatgattatctatttacacggttttgactctaacagtccgggtaaccacgagaaagtcttacaattgcagtttattgacccggatgtacgcttgataagctacagtacgcggcatccgaaacatgatatgcagcatctgcttaaagaagtggacaaaatgttgcaactgaacgttgacgagcgtccgctaatttgcggcgttggcttgggcggatactgggcggaacggattggttttctttgcgacatccgccaggtgatcttcaaccctaatttgttcccttatgagaacatggaaggcaagattgatcgcccggaagagtatgccgatattgccactaagtgtgtgaccaacttccgtgagaagaatcgcgatcgttgcctggtgattttgtcgcgtaatgatgaagcgcttaacagccagcggacatctgaagagttgcatcattattacgagattgtctgggacgaagagcagacgcacaaattcaagaatatctccccgcatttacagcgcattaaagcgttcaaaaccctcgggtaaatgccctcgtcgcatcaggtaaccttgccggtacctgatgcgctccgaattctgtgggtcggataaggcgtccacgccgcatccgacagtcgagcatcaatgcctgatgcgcttcttatcaggcctaccgaacgccctgcatacacccctcactctatatcactctcacaaattcgctcaaataataaacaataaactctgttttttgatctcacccggtaaagtcgcctatcttttcagcaacaaaacttgattaacatcaattttggtatgaccaatgcaccattcatgttattctcaatagcgaagaacattttcattgctgtaacctgttgttaattaagagctatgttaataaccattaattaacaattggttaataaatttaagggggtcacgttgactacgccattgaaaaagattgtgattgtcggcggcggtgctggtgggctggaaatggcaacacagctggggcataagctgggacgcaagaaaaaagccaaaattacgctggtcgatcgtaaccacagccacctgtggaaaccgctgctgcacgaagtggcgactggctcgcttgatgaaggcgtcgatgcgttgagctatctggcccatgcgcgcaatcatggtttccagttccagctgggttccgtcattgatattgatcgtgaagcgaaaacaatcactattgcagaactgcgcgacgagaaaggtgaactgctggttccggaacgtaaaatcgcctatgacaccctggtaatggcgctgggtagcacctctaacgatttcaatacgccaggtgtcaaagagaactgcattttcctcgataacccgcaccaggcgcgtcgcttccaccaggagatgctgaatttgttcctgaaatactccgccaacctgggcgcgaatggcaaagtgaacattgcgattgtcggcggcggcgcgacgggtgtagaactctccgctgaattgcacaacgcggtcaagcaactgcacagctacggttacaaaggcctgaccaacgaagccctgaacgtaacgctggtagaagcgggagaacgtattttgcctgcgttaccgccacgtatctctgctgcggcccacaacgagctaacgaaacttggcgttcgcgtgctgacgcaaaccatggtcaccagtgctgatgaaggcggcctgcacactaaagatggcgaatatattgaggctgatctgatggtatgggcagccgggatcaaagcgccagacttcctgaaagatatcggtggtcttgaaactaaccgtatcaaccagctggtggtggaaccgacgctgcaaaccacccgcgatccagacatttacgctattggcgactgcgcgtcatgcccgcgtccggaagggggctttgttccgccgcgtgctcaggctgcacaccagatggcgacttgcgcaatgaacaacattctggcgcagatgaacggtaagccgctgaaaaattatcagtataaagatcatggttcgctggtatcgctgtcgaacttctccaccgtcggtagcctgatgggtaacctgacgcgcggctcaatgatgattgaaggacgaattgcgcgctttgtatatatctcgctataccgaatgcatcagattgcgctgcatggttactttaaaaccggattaatgatgctggtggggagtattaaccgcgttatccgtccgcgtttgaagttgcattaatcgacgtacactggcggatgtggcataaacgcctcatccgcccttgaggaacagcgcgatcggcagccgcgttgtatcaggcatcctttcagactcctccgaatccttaagtatttccagccattcccgcgcttttcatcttctgtctgatagctgcttttctccttcgcttgcatgattggcataactgcaaagaaggaggtgttcccgtgaataaatcaatgttggcgggtatcgggattggtgtcgcagctgcgctgggcgtagcggcagtggccagtctgaacgtgtttgaacggggcccgcaatacgctcaggttgtttctgcaaccccaatcaaggaaacggttaaaacaccgcgtcaggagtgtcgcaacgtcacagtgacccatcgtcgaccggtgcaggatgaaaatcgcattaccgggtcggtgctcggcgctgttgctggcggcgtgatagggcatcagtttggtggtggtcgcggtaaagatgtcgccactgttgtgggggcgctgggtggtggatatgccggtaaccagatccagggctctctccaggaaagcgatacttacacgactacgcaacagcgttgtaaaacggtgtatgacaagtcagaaaaaatgctcggttatgatgtgacctataagattggcgatcagcagggcaaaatccgcatggaccgcgatccgggtacgcagatcccgctagatagcaacgggcaactgattttgaataacaaagtataacaaggctgtactctgcaatttggcccctcattcgctcaggctgaggggctttttttgcgacttatttcaccagttcgggccataaacgcaaagtcgttccggcaatctgcatcagtttttccagcgatgcaccttcgcgtgcgctgatcgacatcccctgaataatacaattaaggaattctgccagatgtgtcacgtcacagtggggcgggatttccccgcgcgcttgtcgttgacataaaaactgctgcaaagtgcgctcttgcatcgcatggcgtgatttcaacgtattggcgatatctcctgaatctggggagagggtggtgcagttgttgatcatgaagcagcctgccggggtgtctttgctggtaaagcagttggcgatggcagcaaaatagtcagccagcgcagactccacgcttttctcttcacaaaacagctgtgcttcatgcttagcggcaaaacgatcgatatagcggtcgagaacggcacgaaataacccctctttgttggtaaattccgcgtatagcgtgggcgctttggctccggtcgcttcgacgaggtccgcaagagaagtcgcttcataaccgtgttgccagaacaatttcatggccttatcaagcgcggcatccctgtcgaacacttttgggcggccacggcttttttttacacattgtgttgagtcagttgccatgatgccgttgtacctggtgactgtgaatgaaaggttattataaaaataatcacctccgttcaccagtccagatcccataaaaataattgctttctatttaactgaaatttaaagatttttaaattaattaatgattgttataaaaaatatcttgtatgtgatccagatcacatctatcatttagttatcgatcgttaagtaattgcttgcgacgtcattcatctgcataaggccactattatgaaaaacgtaaaaaccctcatcgctgcggcgattttaagctccatgtcatttgccagctttgcggctgtcgaagttcagtcaacgccagaaggccaacaaaaagtcggtacaatcagtgctaacgcggggacaaatctgggatcgctggaagagcagctggcgcaaaaagcggatgagatgggcgcaaaatctttccgtattacttctgtaaccggtccgaataccctccatggaacagcagtaatttataaataagcattaaccctcattaatgcctgctactgctgattttttccccgcgacatgccgtgtcgcggggatttttttatccgggctttacagcgtttgtgggctcacttgatgacggcggacatccaccggcatcccggaacggacatccatcacatgttgcatcacttcagcgtcagtttgtgctgcatctttaaatgattgcattgcgctattcagcgtaattggcagcagctgcggatcgtcatcaatcttctctgacagcggctgatgtacttcaaccagacgcgcaccgtttggttcggcagagacttttatcggagtgttgatgatattcactttggtgcctggggtgacctggctaaagagtgttttgatatcgtcatcccgcagacgaatacagccagaacttacccgcatgccaatgccgaaatcggcgttcgtaccatgaagcaaataaacgccgccataggccgccagacgaatcgcatgatggcccattgggttatccagtccagccggcactaccgcaggcaactcaattccctgtgctttataacgggcgcggatgtttgccgttggcgtccaggttgggtttgcacgtttgtctgaaacggtggtcaccattgtcggtgtcagcgtgtcaccacctaactgaccaatacctattggatacacggttaccgaatttttacccggcgggtagtaatagagacgcagctccgcaatgttgatcacaatgccttcgcgcggcgcatctggaagtagggtttgcaacgggatcgttaacacgctgcccgcgcgcggtacgtaaggatcaacgccggggttagcctgtaacagagcgagaaagccgacgttgtattttttggcgatggcttccagagaaccaccgtcattttccaccacatgaaatttgttttcgccaaccagacgactgcccgctggcggcagcggccaggtgttggcttttgccggtagcgccagcgccacggcagcggcgaacgtaaaaaacgttagccagcgagaaaaacgcgttttgatcatcaccaaaaatccataataaatataaggttattgtaataaacagataagcctgaattatggatggtgacagtgtcggatagtgcagggaagtgcaaagaatttgtaaatgttgcagatgggggcgcagaaacgcccccgatttaccattaagcgatcgcgttctcttccagttcacgcataaactggcgtacccattcgatacgcgttttccgctcactcaaatcctgaataaatttcaggcgcgtcggaccatcaaggcggtaatgctgcggctgtttttgcagcaaaccaatcaaccaggccggattaacgtgattcttctcggcaaattcgatcaccccgcctttctcattaccttccagcttcctgatccccagtttctgcgcttgctggcgcagacgggcaatatccagcagggtacgcgccggatctggcagcaggccgaagcgatcgataagctcgactttgatctcttccagttcgttttccgttttggcgctggcaatacgtttgtagaacgacagacgcgtgttcacgtcagggatgaaatcatctggcaatagcgacggcatccgcagctcgacttctgtttgctggctggtgagatcttccagcgacggctcgcgtccggctttcagtgcatcgacggcgttttccagcaactccatatacagcgagaaaccgatggtttccattgagccgctttgttcttcgccaagcagttcacccgcgccgcgaatctccagatcgtgcgttgccagcgcaaaacctgccccgagatcttccagcgaggcaattgcttcaagacgtttttgtgcatcggtagtcatcgcttttggatgcggtgtcagcaaccatgcatatgcctgatgatgcgaacgtccgacgcgaccgcgtaactggtgcagctgcgccagaccgaagtgatccgcgcgttcaatgataatagtgttggctgtcgggatgtcgatcccggtttcgataatggttgtacaaaccagcacgttgaaacgttgatgatggaaatcattcatcacccgttccagttcgcgctcgcgcatctgcccgtgaccgatggcgatccgcgcttctggcaccagttctgccagccgttcggcggctttctgaatgttttccacatcattgtagagataataaacctgtcctccgcgcaaaatttcacgcaggatcgcctcccggaccaccatgctgtcatactcacggacaaaggttttaactgccagacgacgggcgggcggcgtggcgataatcgacaggtcacgcattccgctcattgccatattcagcgtacgtgggatcggcgttgcagtaagcgtcagaatatccacgttcgcgcgcatcgctttaatgcgctctttatgacgcaccccgaagcggtgttcttcatcgacaatcagcaggcctaaatctttaaacttgacgtcactttgcagcagtttgtgcgtaccgatcagaatatcgattttcccttccgccacttccgcaaggatttgcgtctgctctttggcgctgcggaaacgggagatcatttcgatacgtaccggccagttggcgaaacggtcgcggaagttgtcgtaatgctgctgcgcgagaagggtggtaggcaccagcaccgccacctgcttgtggttatctactgccaggaaagctgcgcgcatcgccacttctgttttaccaaagccaacatcgccgcacaccagacgatccattgccagcggctgacacatgtcgctaagtaccgcattaatggcctgcgcctgatccggcgtggtttcaaacgggaagctgtcgcagaacaactgatactgctcacgatcgtgtttaaacgcgaagccctctttggcggcgcgttgcgcgtagatatccagcaattccgccgccacatcacgcactttttccgccgctttctgccgcgcgcgtgaccacgcatcgccgccaagtttatgcagcggggcgttttcttccgcgccacctgcgtaacggctaatcagatgcagtgacgacaccggaacatacagtttggcgtcgttggcataggtgagcatcagatactcgccagtaatgccacccgcttccagcgtggtcattccggcataacgaccgacgccgtgctccagatggaccaccggctgaccaatatgcagttccgcaaggttacggatcagtgtatcggggttgatggtgcggcgagaatcctgacgacgacgggcaacgcgttcaccgagcagatcgctttcgcaaatcagcgccagattacgcaccgtatcgacaaaaccatgttcggcagcgccaatcatcagataacgcccacggtcgctggcttcatcaagacgcataatgcgttgcggagcaattttaattcgtgcgagcagttcacccagcgcttcacggcgaccttcactttctaccgagaacaccaccggaccgtcgaaagtctcgaggaacttacgcagcgcatccagcggcgctttttgttgtgcctgaacggccaggtctggcagtttctggaaacctaaattggcattcgcggcttttgtcggtaaatgttcagtttttagctgcacccggggccagtttttcagctctgagaagagctcgtccacccgcagccagagcgattgtggtggcaacagcgggcgcatcggatcgacgccgcgattctcaaaacgcgccagcgtgtcagcctggaaacgttcggcactggtttccagatcgccagtattcacgagcaaggtattggcagggaaataactgaacagcggcggcagtggttcgctgaagaacaatggctgccagtactcgatcccggcaggtaatgtgcctttactcacttgctggtaaatatgttctggatcgcgcttcacttcgaaggtatcgcgccactggctgcggaacagttcaattgccgctttatcggtcggaaattcgtgcgcgggcagcagattgatcgcttctacttcctccagcgtgcgctggctgtcgacgtcaaacacccgcaggctgtcgatttcatcatcaaagaaatcaagacgataaggcagctcactccccatcgggaagagatccagcaacgcgccgcgcgtggcgtattcgccgtgctccatcacctggtcaacatggcgataaccggcgctgtccagttgggttcgtaatgcatctcgtgacaggcgctgaccttttttcatcaccagcgcatgaccgtggagaaaactgtgtgggcaaacgcgctgcataagcgtattcaccggaacaatcagtacgccacgctgcatcgtcggtagctggtaaagggtggaaaggcgcgaggagataatgtcctgatgaggcgaaaaactgtcgtagggaagagtttcccagtccgccagattcatcaccatttgatcggtaaactggctgatttcatcatgcaaacgcagagcattttgcatatctggtgcaatgagtaccaccggaccggcgtgacgttcggcaatttccgctaccagcgttgcacaggctgcgccggttaactcgcccagcagacgctgctcacccgctttgacgggcagcgtataacgatattgttcaggcataacggttgtcagattctcgttaggatatgcctcaacatatgggggcatatctctgataagcaatgctgttcattatccgtaatcgacatggtttagcaaattgaatcgccccggctggggcgatggcttagcgggagtaactgacggcagcgggcagtgaaggcggggagaacaacagatcgctgaatgcacgctgtgaaagttttcttaccagcaagcccgcaacagtacagatgaacaaactgacaaagggataaaccagcaggagtgtcagttcgacttgcggcgaccagcgtgctgcgttcatttgcgcaagcagagttaagctgaatatttcaaccagaatgcgatgggtggtgtagatagcaatggtgttggagccaatcacattcagcaggctggtggagcgcataccgaatcgttgctcgtattgataaaacagcttcatgatcaccacaatcgataccagcgacaacagcagcgagatagtaaacaaccaggcaccgaccgccagaacggtaagcaaagaagccatcagcagatggcggcgcaacggcacctctttaacacaggtcattattgttgcgccaaaccatgcgccaaggctgtaataaggcaaattgcggatcacactgttcattccccaccacggcgtgggaacgaaattaaccgccacactcagcagtacaaacaaggcgaatagtggcagcgccagacggctaaaaattttacataccacgaaatagacaattaacgcatacagataccacaagctggtgctggcggtgatcatcccgtgcaggaactcaccggtggaatcggcataagcggcattggaggcattgcttaaatcgcgctcaggtgccagccactggttcagcgcacttaacgccagccactgcaccacgccccaaagcgccagcacccagaagatgttccagatccgtttatcgagacaatttccccacggtacgctgtcgatatagcggcgaatcaaatagccggatataaagaaaaaaaccggcatacgaaagggggcaaggtaaagattgaaatagatccagcatttgctcaggacttccgataacggatgctgaaaagtggtcagatgcggataaaaggtaatgaccgagtgataaatcaccaccagacaaatacataaccctttgatctggttaatccatagctctttttgtttcatcaggacaacacgctcttttttaatttacatgcggttgatcctgcgggttatgacccgaggtgtaatgggtatctgtctgtattggatgatttttcagattaagatcaggcggcaagattgatgataaaacatggcaatttagccgattgatttacgggggcttttcagattagccctgacgatcacttacagttcagacgtttacccatcttgctttcgcttatatactcgtgtctttgctacagcaaccagacggatttcatgtaccaacctgtcgctctatttattggcctgcgttacatgcgtgggcgtgcagcggatcgcttcggtcgtttcgtctcctggctttctaccatcggcattaccctcggggtgatggcgctggtcacagtattgtcagtgatgaacggctttgagcgcgagctgcaaaacaacatccttggcctgatgccacaggcaattctctcttctgagcatggctctcttaacccgcagcaactcccagaaacggcagtcaaactggacggcgttaatcgcgtcgcacctattactaccggtgatgtggtactgcaaagcgcgcgcagcgtggcggtcggggtgatgctcggtatcgacccggcgcaaaaagatccacttacaccgtatctggtcaatgtgaaacaaactgacctcgagccggggaaatataatgtcatcctcggcgaacaacttgcctcacagctaggcgttaatcgcggtgatcaaatccgcgtgatggtaccatctgccagccagttcacgccgatggggcgtattccaagccagcgcctgttcaatgtgattggcactttcgccgccaacagtgaagtcgatggctatgaaatgctggtgaatattgaggatgcctcgcgtctgatgcgttatccggcaggcaatattaccggctggcgtttgtggctggatgagccgctgaaagtcgactcattaagtcagcaaaaactgcctgaaggcagcaaatggcaggactggcgtgatcgtaaaggcgagttgttccaggccgtacgcatggaaaaaaatatgatgggtttactgctgagcctgattgtcgccgttgcggcgtttaacattattacctcactagggctgatggtaatggagaagcagggcgaagtagcgatcctgcaaacgcaaggcttaactccgcgacaaatcatgatggtctttatggtgcaaggggccagcgccgggattatcggtgcgatcctcggagcggcgcttggcgccctgcttgccagccagttaaataatctgatgccgataatcggcgtcctgcttgatggcgcggcgctgccggtggctatcgaacctttacaggtcattgttattgcgctggtggcgatggctatcgcgctgctgtctacgctttacccttcatggcgcgctgccgccactcaacccgctgaggctttacgttatgaataagatcctgttgcaatgcgacaacctgtgcaaacgctatcaggaaggcagtgtgcaaaccgatgtgctgcacaatgtcagtttcagcgtcggcgaaggtgaaatgatggcgatcgtcggtagctctggttccggtaaaagtaccttgctgcacctgctgggcgggctggatacgccaacctccggcgatgtgatttttaatggtcagccaatgagcaaactgtcgtcggcagcgaaagctgaactgcgcaaccagaagctgggctttatttatcagtttcaccacctgctgccggattttaccgccctggaaaacgtggctatgccgctgctgattggcaagaaaaagcccgctgaaatcaacagccgtgcacttgagatgttaaaagcggtggggctggatcatcgtgcgaatcaccgcccatctgaactttctggcggcgaacgccagcgtgtggcgattgcccgtgcgctggtgaataacccgcgcctggtactggcggatgaacctaccggtaacctcgatgcgcgtaacgccgacagcatcttccagttgcttggggaattgaatcgcttgcagggcaccgccttcctggtggttactcacgacctgcaactggcgaaacgtatgagccgccagttagaaatgcgtgatggtcgtctgacggcggaactgagcctgatgggggcggagtaatggcgatgcctttatcgttattaattggcctgcgttttagtcgcggacggcggcgcggcggcatggtgtcgctgatctccgttatttctaccattggcattgccctcggcgtggcggtattgatcgtcggcttaagcgcgatgaacggctttgaacgcgaactgaacaaccgtattctggcggtggtgccgcatggtgaaatcgaggcggtggatcagccgtggactaactggcaggaagcactggatcacgtgcaaaaagtgccgggtattgccgctgccgcgccgtatatcaatttcaccgggctggtggaaagtggcgcgaatcttcgcgcaatccaggtgaagggcgttaacccgcaacaggaacagcgtctgagcgcattaccctcgtttgtccagggcgatgcgtggcgcaattttaaagcgggcgaacagcaaattatcatcggcaaaggcgtggcggatgcgctgaaagtgaagcagggggattgggtgtcgattatgatccccaactcgaatcccgagcataaactgatgcagccaaaacgtgtgcgtttgcacgttgccggtattttgcagttgagtggtcaactcgatcacagttttgccatgatcccgctggcggatgcccaacaatatcttgatatgggttccagcgtgtcaggtattgcccttaaaatgacggatgttttcaacgccaataagctggtacgcgatgcgggtgaagtgaccaacagctatgtttatattaaaagctggattggtacttacggctatatgtatcgcgatatccaaatgatccgcgccattatgtatctggcgatggtactggtgattggcgtggcctgtttcaacatcgtctccaccttagtgatggcggtgaaagacaagagtggcgatatcgcagtattaagaacgctgggggcgaaagatggtttaattcgcgccatctttgtctggtatggattgctggcagggctgttcggcagcctgtgtggtgtgattatcggcgtagtggtttcactgcaacttaccccgattattgagtggattgaaaagttgatcggtcatcagttcctctccagcgatatctattttattgatttcctgccatcggaattgcactggctggacgtcttctacgtactggtcacagcattgttgctgagtcttttggcaagttggtatccggcgcggcgcgccagtaatattgaccctgcgcgagtccttagcggccagtaaaggcagtacattaaaacaaggagcggcaatgtattacgggtttgatattggtggaacaaaaattgcgcttggcgtgtttgatagcggtcggcagttgcagtgggaaaagcgggtgccgacaccgcgtgacagctatgacgcatttttagatgcagtgtgtgagctggtagctgaagctgaccaacgttttggctgtaaaggttctgtcggcatcggtattccgggaatgccggaaacagaagatggtacgctgtatgccgccaatgtccccgctgccagcggtaaaccgctgcgtgccgacctgagcgcacgtcttgatcgcgatgtacgccttgataacgatgccaactgttttgccctttcagaagcctgggatgatgaatttactcaatatccactggtgatggggttgattctcggcaccggtgttggcggcgggctgattttcaacggcaaaccgattaccggtaaaagctacattaccggcgagtttggccatatgcgtctgccggttgatgcgttaaccatgatggggttggatttcccgttacgccgctgcggctgtggtcagcatggctgcattgaaaattatctgtctggtcgcggttttgcgtggctgtatcaacactattatcatcaaccgttgcaggctcccgaaattattgcgctttatgatcaaggcgatgagcaggcaagggcgcacgttgagcgttatctggatttattagcggtttgtctgggaaatatcctgaccatcgttgaccctgacctggtcgtcattggtggtggcttatcgaatttcccggcaatcacaacgcaactggcggacaggctgcctcgtcatctcttacctgtagctcgtgttccgcgcattgaacgcgcgcgccacggtgatgcgggaggaatgcgtggtgcggccttcctacatctaaccgattaaacaacagaggttgctatgctgtcgcgtcggggtcatcggttaagtcgttttcgtaaaaataaacgccgcctgcgcgagcgtttgcgtcagcgtatttttttcagagataaagtggtgccggaagcaatggaaaaaccaagagtactcgtactgacaggggcaggaatttctgcggaatcaggtattcgtacctttcgcgccgcagatggcctgtgggaagaacatcgggttgaagatgtggcaacgccggaaggtttcgatcgcgatcctgaactggtgcaagcgttttataacgcccgtcgtcgacagctgcagcagccagaaattcagcctaacgccgcgcatcttgcgctggctaaactgcaagacgccctcggcgatcgctttttgctggtgacgcagaatatcgacaacctgcatgaacgcgcaggtaataccaatgtgattcatatgcatggggaactgctgaaagtgcgttgttcacaaagtggtcaggttctcgactggacaggagacgttaccccagaagataaatgccattgttgccagtttccggcacccttgcgcccgcacgtagtgtggtttggcgaaatgccactcggcatggatgaaatttatatggcgttgtcgatggccgatattttcattgccattggcacatccgggcatgtttatccggcggctgggtttgttcacgaagcgaaactgcatggcgcgcacaccgtggaactgaatcttgaaccgagtcaggttggtaatgaatttgccgagaaatattacggcccggcaagccaggtggtgcctgagtttgttgaaaagttgctgaagggattaaaagcgggaagcattgcctgatgcactacgcttatcaggcctgcaaggggacgcaattaattgaatttgcgggttttgtgggccggataaggcgttcgcgccccatccggaataatacacgcgcacttttccggcctcttttatcgtttactcgtcaataacaatgcggcaataaacgtacagacaccaattagccctgcccagagtggcgatattctggtaatcgcaaagctattatcgatatacaaacataaagcctgataacccatattggcaatagtcatcgccactgcaaattttaacgcataaataaaacgagtcgtgtagtaaaagatcctggaaaataagataaacgtcgcagcccaggcgataaaacctaatgtgttggtgctgccggggggagcattttcatgctgttgtcctggatgcggataatacgttagtggcggcgtcgattgttttaatatctgtgcttgtagaacagccaatgcattattgattccctgataccagagatctgcatttaaataagccagcgtgtgattttctatcagaaggccgagatgtttatcgtccagaccactttcaacctggccgttggtgatcataattaaccgtggttcgcgggtagtaaatagtaacagaacacttccttttacatcactcaatgaagatgacgcatgcgccagcatcgctttaccattttgtctgagactggcttcattattaatgtcgggtaaaaccacaataaacggtgcaattcccgtttgttggcgaaaaagctcggctttatgcgcgatctcttcagcatctggtacagtaccggtaacgtccgtaaaaagtgtcttcattattggaattaatggcttgctggctgctgtcagaggcaggagtatcagtaaactgagcagtataatgaattttttcatgggcgggacttccgtttcctgcgtgattttttagaggagggcatacttattaataaaccgacggcgataaaaataacgcccataatgccgataaacccccatttaaaaaaattaacccacgggttatttatctcagccttttcaggatgcccgggagaataataaacattaactttatcgccttcgctgtcttcataaaaatcgctgccgatactcgaattgaaaattagcgtgtaatctggcgtcggtcgaaaggcaacgacgggataccacgaaccatctttacccgtgcgatgagaatgactggagtgccagacggtatcaacaatgacgccttcggtatgaatcgcgtctttgctataggtgaactggttataaaagacaacaacagaaatgaggatcagtaccagaccgataccgaggaatatacgaaagaaaactttactgtcctgactcattagccacatccttgctaactaaaaaacgggcggtaataccaccgcccgcttgctgaattaacgtcctgctttcagcttctgataatactcttcataaatgctgctggctgcgccaacgtcattctgccattcgccatttttaatggtttcagcatccgggtagagtgttttatcgttcgccacttctggacttaacagcttacgcgccgcaaggtttggcgttggataaccgatagtttcagcaacctgttttgccacatccgggcgcagcaggaagttgatcaatttcagcgcgccttctttgtttttggcatttgccgggatcgccaggctgtccatccagaaaatgccgccttctttcggccacaccacgtcaattggcgtacccgcctggcgtgcaacgaaagcagaaccgttccagatcatgccgaggttaacttcgccttccatgtacgggttcgccgggttatcggagttaaaggctgccacgtttggcatcagttttttcagctcgttatatgcagcttcaatctctttcggatcggtggtgttaccggagtagcccagcttacgcagcgccatctggaacacttcacgggcatcgtcggtcaacagcaggctgcctttgtactctggcttccacagatcggcccagctggtgacagatttcggatccaccgcatcaccgttaacaccaatcgccgtcgcaccccagatatacggaatggagtagtcgttattcgggtcaaaaggcttgttgagcatgtctggatcgagattgctgaagtttgttaacttcgacttgtcgatcttctggatcatcccttctttacgcattttatcaacgtaataggttgaaggaaccaccagatcataggcaccgtctttgtatgttttcagcttggcgtacatggtttcgttcgactcgtaagtcgaatagataaccttaataccggtttctttggtgaactgttcaagcagtcctggcggcacgtactcggtccagttgtagaaatacagcgtgttgttgtcatcggcgtgagcggcgctcatgcccagtgccagagcacccgccgcgagcaggtggcgtgaccattttttcatttaacgtcccctgtgttacctttcgttttatcacgagcaataagctggctggcaataaccatcaccagcgacagcaccagtaatatggttgccagcgcgttaacttccggcgatacgccgactttgaccatcgaataaatttttaacggcagaatttcataacttggtccggtgacgaacgaagaaactaccacatcgtccatcgacagggtaaagcttaacacccagcccgccgccaccgctggcattgccagtggcagaatgatttttcgcagaatggtaaattcgctggcaccgagatctttcgccgcttccagcattcgcacgtcaaaacctttcaggcgcgaatacaccgtcaccaccacaaatggcaggcagaaggtgatatgcgagaacagcagcgaccagaagccaagctgaatacccagcagcataaacagcaccagcagcgaaatcgccatcacgatatctggtgacatcatcaccacaaacagcattccgctaacgaacggcttaccacgaaagcgataacggtacagcgcaactgccgtcagtgaaccgataagcgtagcaaacgtcgccgaaaacaccgccattgttagtgaatgctgcgctgcctgtaacaggctgtcgttgttcatcagcaggctataccatttggtggtaaagccctgccagttgatgccaaagcgcgagctgttaaaggagttcacaatcaaaataatgattgggatatacaggtacgcgtagatagcggtcataaaaccgccgcgaagcagtcgaccgatcattcgagttccaccttcttattcagcaaacgagaagcgcgccagtaaaccagcaacatcaggcccattacgatagtcagcgtaatgctggtagctgcaccaaacggccagtcacgaatattaaggaactggaccttgatgacgttaccgatcagcaggtttttcgcaccgcccatcaggtcggatacatagaacaggcccatcgctggcagcatcaccagcagacatccggcaataattcccggcatcgtcagtggaataatgatacggataaaagtctgtaacttgctggcaccgagatcgcgcgccgcctcaagcaacggcttatccagtttttcgatactggagtacagcggcatcaccataaacggcagcagaatgtaaaccagaccgataatcaccgcactgggcgtgaacatgatacggattggtgtgtcgataacgcccagccagagcaaaaactcgttgagatagcctttggtgctgaggaaaattttcagcccgtagatacgaattaatgagttggtccagaacggaacaatcagcagaaacagcagcagcggacgcaccttgtgtggcaacttcgccagaaaccaggcaaacgggtagcccagcaccaggcaggcgagggtggcgatcagcgccatattcagcgagtgcaatagcacttcaaaatagagcggatcgagcagacgcgtgtagttatccagcgtaaagaccattttgacaaaactggcgtcgtcgcgggtcaaaaagctggtgccaatgatcatcaggttgggcagaaagacaaacaacacaagccaaccgacaatagtgacaatcactacattctggaacttacttgtgttcttcatcagccagtacgacctcccagctttctacccaattaatggccattttttggtcgagagagtggtcaaagtcaggatcgtcttcattgaagaattcgctgaccatcaccatcttgccattttccagttcaacaaccgactccagcgtcatgcctttgtagttacgctcgcgaacgtaaccaatcagcccttcagcgtggttgtcgtcgttaatctcttcaacacgtaagtcttccgggcgcagcagaacatgcagtttttgccccggttcaacggcgaagttaacgtagatattacattcgcggccttcaacgttggcgcgtacgcgctgctcgtctagacgttcgatgacagtggcgttaaacatattgatttcgccaatgaagccggcaacaaacaggtttttcggctcttcgtagatttcacgcggcgtgccgtcttgctcaatgcgaccatcgcgcatcaccacaatcctgtctgacatggtgagtgcttcttcctggtcgtgagtcacaaagacgaatgtaatgccaagcttacgctgtaacgctttcagctcgttctgcatttgcttacgcagtttgtaatccagcgctgagagcgactcatccagcaacaacagacgaggcttgttaaccaccgcgcgagcaatggcgacgcgttgctgttgaccaccagagagctgatgcggtttgcgttgagcgaaggtttccaactgcaccatccgcagggcttccatcacgcggggcgtaatttcagcagcgggggttttttgcatgcgcaacccaaaggccacattttcgaacacggtcatgtgggggaaaagtgcgtagctttggaaaacagtgttcacatagcggttttccgccggaacgtgggtgatgtcctcgttatccagcatgatgcgtccggaatcaacagtttccagacctgcaatcaggcgaagaacggttgttttaccgcagccagaagggccaagcagcgtgaggaactcgccattgttgatagtcagatccagctggggaatgacctctttaccatcaaagcatttgcgaattcccgccaattgcaccagcggtgaaagcgaactcggttgtttattcaattttttactctgtcccatgtaaacgcaacggatggcttaccgatgcggggtttgtggttaaccaccttggtgactcttaatgagggcggtaattctacggcaaaccgcttgaatcgccaatctttgttgtgaattactggcttagctttatattcattaaggtaatgctgataaatattcccgcttgcaggggtaaaagtgacctgacgcaatatttgtcttttcttgcttcttaataatgttgtcacaaaaagtgagggtgactacatggataaactacttgagcgatttttgaactacgtgtctctggatacccaatcaaaagcaggggtgagacaggttcccagcacggaaggccaatggaagttattgcatctgctgaaagagcagctcgaagagatggggcttatcaatgtgaccttaagtgagaagggcactttgatggcgacgttaccggctaacgtccctggcgatatcccggcgattggctttatttctcatgtggatacctcaccggattgcagcggcaaaaatgtgaatccgcaaattgttgaaaactatcgcggtggcgatattgcgctgggtatcggcgatgaagttttatcaccggttatgttcccggtgctgcatcagctactgggtcagacgctgattaccaccgatggtaaaaccttgttaggtgccgatgacaaagcaggtattgcagaaatcatgaccgcgctggcggtattgcaacagaaaaaaattccgcatggtgatattcgcgtcgcctttaccccggatgaagaagtgggcaaaggggcgaaacattttgatgttgacgccttcgatgcccgctgggcttacactgttgatggtggtggcgtaggcgaactggagtttgaaaacttcaacgccgcgtcggtcaatatcaaaattgtcggtaacaatgttcatccgggcacggcgaaaggagtgatggtaaatgcgctgtcgctggcggcacgtattcatgcggaagttccggcggatgaaagcccggaaatgacagaaggctatgaaggtttctatcatctggcgagcatgaaaggcaccgttgaacgggccgatatgcactacatcatccgtgatttcgaccgtaaacagtttgaagcgcgtaaacgtaaaatgatggagatcgccaaaaaagtgggcaaagggttacatcctgattgctacattgaactggtgattgaagacagttactacaatatgcgcgagaaagtggttgagcatccgcatattctcgatatcgcccagcaggcgatgcgcgattgcgatattgaaccggaactgaaaccgatccgcggtggtaccgacggcgcgcagttgtcgtttatgggattaccgtgcccgaacctgttcactggcggttacaactatcatggtaagcatgagtttgtgactctggaaggtatggaaaaagcggtgcaggtgatcgtccgtattgccgagttaacggcgcaacggaagtaagcgaaaagggatgcggcatgtgatgccgcatccggcttaaatccaaacttacccttcgaagaaccaatacccgctattgaccagcgccgcgagcatcgcgaggaatgacggatcttccagcgcatcgccaaaattctccgcagtcagcgcaatgttgctggcgagtgcatccagtgccggacggtgcggggaatcgatcttctcaccattggcatacacgtcgtcgccaatgcgcaatacgcgcagaccacccaggcgcaccagcacttcaccttgtttcagcgcatcgtagatttcatccggctgataaggcggctctggcggcgcgatatccagttcatgacgtgactgggatataaactcgccaaaccattgcttaaagtgttccggctggttgatcaattcgagcatcatctcacgcagtttatccatctcttgcggcagaacatccgcaggatgagcgcgaggtggaacatccggatcgctgtagtagttgccgcccagttcacgttgcagcacataatcggcaaatccactaatcagttcccgcgtatttggcgcgcgaaagcccacggaatagttcatcgcattttccagcgcgtagccttcatgcgggaatcctggcggaatataaagaatatcaccaggctccagctcttcatcgatgatggcttcgaacggatcgacctgtaacagatccggatgtgggcagtgctgtttcatttgcagcttttcgcccactcgccagcgacgacgtccggtaccctgaatgataaacacgtcgtactgatcgagatgcgggccgacgccgccgccgggtacagaaaaagaaatcatcagatcatcaatacgccagtccggtagttcacggaacggtcgcatcagcgcggcggtcggctcatgccagtggttcactgcctgtaccagtaatgaccagttggtttcaccgagatgatcgtagctttcgaacgggccgtggctgacctgccatttgccatcctggtgactgaccagtcgactgtcaacttcgctttccatcgccagacccgccaactcgtctggagagatcgggtcaataaaattattaaagccgcgttttaacaccaccgggcgtttctgccagtgacgttcaagaaaatcgggccagttaagagtgagttggtattccatgttaagcatccacaggctggtatctgcaaccgattataacggatgcttaacgtaatgcgtgaagtatgggcatatttattcatctttcggcgcagaatgctggcgaccaaaaatcacctccatccgcgcaccgcccagcatgctctctccggcgacgattttaccctcatattgctcggtgatttcgcgggctaccgccagccctacaccttgcccagggcgtaaagtatcaacccgttgaccacggtcgaaaatgacctctcgcttgcttaatggaataccggggccatcatcctcgaccacaatatagagatgctcgtcggtttgccttgcagaaatttcgacaaactcgaggcaatatttacaggcattatccagcacgttgcccatcacctcgacaaaatcgttctgctcaccgacaaagctgatctctggcgaaatatcgagagagatattgacccctttgcgttgatacactttgttcagcgctgaggtgagattgtccagcagtggggcgaccggatgcagctcgcggctgagcaatgtcccgccgcgcatactggcacgatgcaggtagtagccaatttgctgtgaaatgcggctgatttgctccagcattaccggctcagcatcactgacgctcatcttttcactacgcagagaacgcagcgtactttgcagcaccgccagtggcgttttcagactatgggtcaggtcggtgagcgtcgtacggtatttgtcgtaacgttcgcgttcactttttaacaatcggttcaggtttcgtaccagactggtcagttctcgcgttgtggctggattgagcaattcgcggttatgttcttccagttcgcggacttcttttgccagggcttcgatggggcgtaaactccaccaggcggcgacccacagcagcgggatcactaacagcagattggctgagagcacatagataaaccagctccagaccatataggaactttttagctccaccggaatggtatccaccaccacaatggttaattttggcatccgcgatgttgccgggtagacgtttactgccaccgagtgggtcatctccgcgtcgtcatcatcttcccgcacttcctgcaactgttgctgtatcgaatgatctccactcagcaagaggctggtatcgttaacatccgcttcaatttcatgaaaaccattcgatttcagccagtcaggctggatcatcttcatcagccagggcacgtcacgttgcgcccataaaagctgcccgttctcatcataaattagcgtcatggtggggctttgcttgtcgatattttcgggtaactcgacatgcaacttattgttttcccacttcgcaagggtatagaacagattgctctcgccacgtaacagccgaaacgtagttttatcgaaactgacgctataaccgatcagcgcgaccattccgtaggcaagcgaaagcaccagtactaccgctgccgttgccaacagaaaacgtacccgcagcgagagcgggaaaaaaagacgcagtaattttttcatcagcgcaattcgaacagatagccctggccgcgaacggtggtaatcacttcttggggatattgtgcctgaatttttttgcgcagacgtcccatcagtacatcaatggtatggctttcccgcagctccgcatccggatagagttggagcattaacgaatctttgctgaccactttgccattattgcgtatcaacgtttccataatagtgtattcgaacgcggtcagtttgatcacttcgtcattaatagataattcacggcgagagagatcaacctgaaacggggggagcgaaatgacctgtgaagccagaccgctattacgccgcattaatgcctgcattcgcgccatcacctcttcaatatgaaacggtttagtcacataatcatcagcaccggcacttaatacttcgactttgtcctgccagctttcacgggcggttaataccagaatcggcagtgaaacatcgttgctacgccagcggcgaatcagtgacagaccgtcctcgtctggcaatccgagatcgacaatcgcaatatccggtatatgttcattgagataataatcggcttctttggcatcttctgcgtcatcgacctgatgaccagcatcctgaatctgaactttaaggtggtgacgtaacaacgcattgtcttcaacaaccagtacgcgcatttttatttctccctgtcttaattattaaaatagtgtaacgcgattatgtggttatgggggtaaacattaaataaaccagcggggaggggaggtaaagtgaaaaaataaaaagcggataatcttaataagcaggccggacagcatcgccatccggcactgatacgaggtttatttcagctcatcaaccatcgtgatagctcgaccaatatagttagccggcgtcatcgctttcaggcgggctttctcttcttctggcaacgccagaccatcgataaactgcttcatgccttcggcgtcaacgcgcttaccgcgagtcagctctttcagcttctcgtacggtttttcgatgccatagcgacgcataactgtctggattggttcagccagcacttcccagttgtgatccagttcatccagcagatggtcacggttcacttccagtttgctcacgcctttcagggtggattgatatgcaatcaaggcataaccgatacccacgccgaggttacgcagcacggtagagtcggtcaggtcacgctgccagcgggaaaccggcagtttgcttgccagatgctgcaataccgcgttggaaaggcccagattcccttcggagttttcgaagtcgatcgggttaactttatgcggcatggtggaagaaccaatctcaccagcaatggttttctgtttgaagtggttaagggcgatataaccccagacgtcacggtcaaagtcgatcagaatagtgttgaagcgcgcaacgcaatcaaacagttcggcaatgtagtcgtgcggttcgatctgggtggtgtacgggttccactgaatacccagcgaggtgacgaactcttcgctgaactgatgccagtcaacttccgggtaagcggcgatgtgggcgttatagttaccgaccgcgccgttgattttgccgaggatctccacctggttaagctggcggtactggcgctccatacggtaggcgacgtttgccatctctttaccgatggttgacggcgtggctggctgaccgtgggtacgagacagcagcgggatatcgcgatactgaacggcgagatctttaatgccatcaatcagttgacgccagtatggcaggatcacttcatcacgcgcggttttcagcattaatgcgtgggagaggttattgatatcttccgaagtacaggcaaagtggatgaattcagaaaccgcgtgcagttccgggatctccgccactttttctttcaggaaatactcaaccgctttaacgtcgtggttagtggtacgctcgatagttttgatgcgcgccgcatcttcttcgctgaaactggcgacgattgcatcaaggtaaccgattgcgtcggcagcaaaagcaggaacttccttgatcgctgcgtgcgcggccagtttttgcagccaacgtacttcaacttgtacacggaatttcagcaaaccatattcgctgaaaatcccgcgcagcgcgctgactttatcgccgtagcgtccatcgacaggggaaacggcggtcagtgaggataattccatagatcacaactccggggttaaatgagcaagaatttgttttgcctgagtggtcaggcgattacgagaaaacatcagttgcagacgtccgccgccgacctggtgccagagcacggcggcgcgaatgcctgccagcagggttgcgcgaactttcgcctgcacttgtgggctttgcagtacagcaggggaaccggtgacctgaatgcgcgggccaagcgggctaatcacatcaacatagatagcagccatcgcgctcatcagcgtttcggactgtaaatcgaagtgttcgagctggcgttgcaggccgttgatccggttgcccagagtgtcgagcgcgcctttcgctgaggagagtttgcgctcaagcaccatcaagctgagtgtgtagcgggttaattcggcgtttaagccctggcgactgctggcattgagcacgccgagcagggtttccagcccgacgcgcaggttggcttcgctaccgccaaaaaccgccagcgtcgagctggggttcatatcaataatactgttgagtgagacgtgtagcgcatcggcatcacaatgcccctggtgagcgagttgttgcaccaggcgtgccgactgacaaataccggccagggcgagggtgatgtcatagtaattctttgccacgttcactgcttccttgttttaagtaaagataataatcagaccggcagcggcagacgctgctcaataataccgccaccgaggcacacttcaccgttatagaagacggcagactggcccggcgtcacggcggcaaccggttcatcgaaaatcacttcaatgcgatcatcgtccagcgccttgacggtgcaagggatatcggtctggcgatagcgggtttttaccgtgcaacgcatagtgccggtgaatggttcgcgatcgacccagtgcaactgctgggcaatcaacccgacagacatcagccgcgggtgttcatggccctgagcgacaaccagaatgttgttttcgacgtctttgtccaccacataccacggttcttcggtaccttctttggtgccaccgatacccagacctttacgctgaccgagagtgtgatacatcagcccctggtgctcaccaatttcatcgccatcgacggtaatgattttgcccggttgcgccgggagataacggcccaggaactcgcggaatttacgttcgccaatgaagcaaatgccggtagagtcttttttcttcgcggtgaccagaccaagatcttcagcaatcttacgcacctgcggtttttccagttcgccgaccgggaacaggctttgcgcaatctgctcatggctgagcgtataaaggaagtagctctggtctttattgctgtccagaccacgcagcaggcggctcttgccatcgacatcggcccgacgtacgtaatgaccggtagcgatataatcggcacctaaatcttcggcggcaaattcgaggaaggctttaaatttgatctctttgttgcacagaatatccggattcggcgtgcgaccggctttatattcggcaaggaacagttcgaagacgttgtcccagtactcggcagcaaagttaacggtgtgcagttcaatgccgagcttgtcgcagacagcctgggcatcagccagatccgctgccgctgtgcaatattcctcaccgtcgtcttcttcccagttcttcataaacaggccttcgacctgatatccctgttgttgcaacagccaggcagaaacggaggaatcgacaccgccggacatgccgacgattactttttttgcggtttcagacattggatcactcacgacattgaacttcaaggcggcgtattctatcacgcagccttttagatgacaccctttgtaaaaggccagttaaaatcgccaatcatctccagcggataacgttgcccgctttgataacaacgaatactttccgccaccagcggcgaacgaagatttgacgcctgtaaaatttcttcggcgctgacccaacggcagcagtcgatatcgctgtcatgaggctgggtcgggcatatttgctcaagctcaatggcaaagaggaaacgcaaaaacggcgttttatctggcgcaatccactgatgcatacgaataaagtgttgcggctgcgcgctgatgccggtttcttcccacagttcacgggcggcggcttccactaaggtttcatcggcttccagatgcccggcaggttggttccataacgctttaccattaatcgtctcttcaacgactaaaaatttgccttctgcgtgcaccacgcaagcaacggtaacgtgcggtttaaacattttgcatccttaatctgtcacttctcgccattcaccattggcaagattatccaaagagtaatcacccatcgcatagcgaatcagtcgcagcgtggggaagccaacatgggcggtcatgcggcgcacctggcgattacgtccttcatataaggtgatcttcagccagctggtgggaatacttttgcgttcacgaattggtggattccgcggccataaccacgcgggttcgtcaaccagctccgcgccggcgggcagggtagggccatcatttaaggttacgccattgcgcaaggcttcaagtgcgtcttgtgtgggaataccttccacctgcacataatagatttttccggtgcgtttacccggctgggttaaacgcgcctgcaacgcgccgttattggtcagcaccagcaacccttcgctatcgcggtcaaggcgacctgctgcataaacaccctgaaccgggatgaattcttttaatgttttgcgtccggcttcatcggtgaactgcggaagaacatcgtagggtttattgaacaggatcacacgcgtgggctggttttcaggtttacgcctggtagaacgttgcgagctgaatcgcttaacctggtgatttctaaaagaagttttttgcatggtattttcagagattatgaattgccgcattatagcctaataacgcgcatctttcatgacggcaaacaatagggtagtattgacaagccaattacaaatcattaacaaaaaattgctctaaagcatccgtatcgcaggacgcaaacgcatatgcaacgtggtggcagacgagcaaaccagtagcgctcgaaggagaggtgaatggaaagtaaagtagttgttccggcacaaggcaagaagatcaccctgcaaaacggcaaactcaacgttcctgaaaatccgattatcccttacattgaaggtgatggaatcggtgtagatgtaaccccagccatgctgaaagtggtcgacgctgcagtcgagaaagcctataaaggcgagcgtaaaatctcctggatggaaatttacaccggtgaaaaatccacacaggtttatggtcaggacgtctggctgcctgctgaaactcttgatctgattcgtgaatatcgcgttgccattaaaggtccgctgaccactccggttggtggcggtattcgctctctgaacgttgccctgcgccaggaactggatctctacatctgcctgcgtccggtacgttactatcagggcactccaagcccggttaaacaccctgaactgaccgatatggttatcttccgtgaaaactcggaagacatttatgcgggtatcgaatggaaagcagactctgccgacgccgagaaagtgattaaattcctgcgtgaagagatgggggtgaagaaaattcgcttcccggaacattgtggtatcggtattaagccgtgttcggaagaaggcaccaaacgtctggttcgtgcagcgatcgaatacgcaattgctaacgatcgtgactctgtgactctggtgcacaaaggcaacatcatgaagttcaccgaaggagcgtttaaagactggggctaccagctggcgcgtgaagagtttggcggtgaactgatcgacggtggcccgtggctgaaagttaaaaacccgaacactggcaaagagatcgtcattaaagacgtgattgctgatgcattcctgcaacagatcctgctgcgtccggctgaatatgatgttatcgcctgtatgaacctgaacggtgactacatttctgacgccctggcagcgcaggttggcggtatcggtatcgcccctggtgcaaacatcggtgacgaatgcgccctgtttgaagccacccacggtactgcgccgaaatatgccggtcaggacaaagtaaatcctggctctattattctctccgctgagatgatgctgcgccacatgggttggaccgaagcggctgacttaattgttaaaggtatggaaggcgcaatcaacgcgaaaaccgtaacctatgacttcgagcgtctgatggatggcgctaaactgctgaaatgttcagagtttggtgacgcgatcatcgaaaacatgtaatgccgtagtttgttaaatttattaacgggagcgtaacgctcccgttgttttttgttaggctgctaacggttatcaaaattttatcaaaaaaagttatcaaaacccctcggtagttttggggtaggctggccggtcaggtggtagttctactactagtctcccacatagatattccttagctttttattattgctggcggacgctcgttaatatttaaggtcttcattgattaagacatccccaaagttagttatgtattcactgttattaggacaattatgaattaccactccttacacccgctcaaatattgttaaattgccggttttgtatcaactactcacccgggactcgccaggggacagccaacaggcattgggtgcaatcaccttagcgttcaggtacatgcggaatgtaaaaaaggccgcgagcgcggccccttcacatacatctttagtactgagactgtttaacctagggaattattatcgtattatattgcattacaactcccaacagtgacatatgaacttcctgctttactccacgactttaatatttcaaggccatgtgaagaacatatttcttgcactgcgagttcatcgagtaatccatagtaagaaacactttttgaatttttgtaaatgtatccgtaaagatgttttcttcctgtttcgtattttttgaagtatgagcttttatattgatttacaataagagtctcacctcctgattttagtaatctcttgatgctaagaactattttgtcgattgtatcccgacaaggaacggcagagagaacattagagcaaaggatgaaatcgtaacccccaattattttgtcgacatcctcgaaagcaactgtatttgcatttttataatatcgtgggacatagtcaataattttagttttaattcctctaataatttgctctctttcaagttgccttttcgagtctagaaaagtaacttcatcaaatttactgattaattcatcagaatatctaagttttccgcagccaaaatcaagggcgtggccatttttctcaatgcttctaatatactcgcaaagatatctagagggcatcgtatgaggttttgctgcattctctgagcgaatattaactccgtgcatattatagttcaaagcaagtaccattcaattaatgttatttttagtgaaaaattcttttattttatcgtccgggatttttccgacttgactttcagttctgggcttaactgtcaaagcaaagataataccactcactgagaatgataaaattacaaaaaagaataaagacagcaaagaaccttcaacatgaaaaatatccatttgtttgcaaaaaaagattattaggaaggaaattaatgcaattatcgaaaattcaaaaaatatccaaaaatagtatactttattccagaagagttcaatataatgtttgtcttcaatttttcttacttcagggtaatatagattgctcattacattgtgagcttcatctttatttaattttctgttgactccagctctccgtgataacggttttataattagatgcttatcccaaagatatcgcacccgaagtagtttggctgcattgttatgtaggtctaacgcaccgctaattaaatatgcaaaaatcgcaaaagcacaaggtaatataccaaaagatagtgcccaattaataaagctctcatgatctttaataggtgggacatacttggttggtaatgttattaaagggatgtattcgtaaataactagaagtatgcaatatattagcgtatttaagaaagttgctttatgaagtttaggcaacatttcattataatttttggggggttcgaacatattattcacctgagtcacgctttaggatagtgtaatggtaatatttaattaagtgtcattatatacttttcagtaggttagttacaattttttgtatctgttcaggctgacctagcttcgctgacagacaatattgtgatcagtagcacgtatcgaggaggagtagcgctacaaatttgacgctgggtgagaatctgaaattgatagaaatgaaataatgaaataatgaaatgatgaaatgatgaaatgatgaaatgatgaaatgatgaaatgatgacagagtgtccagtgggcacggatggtgtcttacgacatgcttaccttaatcgttcccagtgtgcctatagcagatattctaaacatgtcgataattcattacgcatatagtatcgaacatagaaaaaactgaagattcatcttattttgtatatactacctagcccaacaatgtagaggttaacgaaaaatgcgctcaccaatttgtcatcttttctcagcaattaattcatcaccatttaagattgcaccagagaaggagcaagatcttaaaacgatagttgacgacaaaaaaattataatttcagttgtgagtgaacctggttttaatatccgagtcaggaagaatgagagtaataattcacatgaaatagttctaacagtagcttcacttgaatatatttgggcattttccaatttcttttgggtttttacgcaagagtactccaaatctcagaaaaataatgatgagcactttgatttaacaggaaaaaataggcttaaaaagtctgatgaacttcttaaatgggcaaggaaaaacttgcaaacaacaggttgcgaatcatggcctaaaaaatgtcccaagccagaagcatatttacaaggaagcgaagactcacaagttgctagcgagatatttctttgtgctattgcttggattcttcatcatgaaataagtcatgttgttttacagcatccattggtcactacagcattctccactcaagaggagcgtgaagcagattcacatgctacaaaatggatattaggcaacctgtatgaatccgctcctgaattaaagaaacgtgcacttggcattgctacggcagtgctttgtatacaaagcttagaagttgaaaattacttctgtttacaaaatacacacccagctgcatatgagcgtatatattcgaatatttcatgctaccctgtcggaaatgaagagttgattgaagctctatgtacagtgatgcttcaatatcttttccatggcaaaaatatcaatgtgaatctagatggggagtccttttcatcgattttaggtgatcttctctgtgatatttcacgtcttaccagtaactgatatggctgtccgccgctcgcttaaagtggactttttagtttttatcatgtgcggtgagaaattcaatgtggcgttgagatgcttaaaggttcacaacgctactttgctccatcctttacctcgatcatcatgataacgatcggtttgttgttgtgttttatgaccaagtagtttttgtgtgtctaacccctgttctttatacagacgttcagataaagacctttgctcatggaatgtcgcaggtgaaccctctccccagtcaattcttgctaaatctctcgctttactaaaattcatcgtcaatgtattggctttaacctgcgctccgcgctctgcttgtgaagttgaacgaaaaaaatgcactaagtatgcactgactgcatagtcacggcagcgggctactacatcgcgtaaactccagttaatcgcattgaggcgaagagaaagaggaattgcgattttgctcccggtcttttcctgaatgacatgaagatgatcatcccaaatatcgctaaatttcatacgcgaaatatcacctaaccgctgaccagtaaccagcgctaacagcatggcatttcccatgtaacgatgagtagcgtctgcgatatcgaagatttttttccattcttcaaggctcagccgttgtcgggtaatttttcttcttggttgtttagtggctaatgctgggttatagccaggaggtacttctccgtagtgctgcgcctctttgaaaacatcaatcaggacggagcgaactacttgtgccattcttggccgcccagcggcgatatactcatcaagcaattgtgctatatctctgacatcaacggctgagatcaacttcattcctgctcgttctctgagcaaggatactggtttagctttttgtttataggtgttgagtcttatatcaccacttttaagcctgtcatcctggatcgcttgatagcgatctaaccaggttgacgttgtgatagcctttcctttgctggttgcgatcctgtcactgatagccagaatctgccgggttctttgttcagccaggcgagtgttggcctcagtggcaatagcgatagcttcagcttcgtttgttcccaaagcatggaattttcctgtcactggatgcttataccgccaatagactttatttaccttcctactataaagcggatataagttagggactgaaacattattcttacgcggtctggctgccattactcaaaatccgttgcaaaagtaatgagtcatttttcttgattacaggtgttaccaactccccaactaactcggcgtcctcacgcactcgccataaccggccttgtttcatggccggtggacaaaataaattctgcttagcataacgacgcaatgtggacacacttggaggattacttctgtatttttcagcagcccattcttcaagagttaacatttgaagcatatgcgatcaccttattactacactaactgcttagtctcagcatatcgaccctgcacggtcggttagtttctccacaaaacagagaagagcacctgtggccacagctatcaggatgggtcgggttattaacccgtcatccggggatactcttctctgttttgtaaaaagggcggtaccagaaaggactaaggaaaaaactggtaccgccaagactacacacagcataaagttgtggtgtcgggtgcccccggtgcctggcgaaggttgcacaccaggcgggtgggtatccacagaaggtcgattgtcagcctcaaccttaacccgcgtgcgctgagccgcattcaccacaacgctaaggattctctctggttgaaaatacttagctgttatgtgcctgtcttttcaccacttcaggctcggtggtatgctggagttctcacacagccagcaagcaaggaaacttaatgaaccagttttatgttcacgttcgtctatttgaagacacagccgaacagaccaaaaaatttgaagaattaatgcttaactttctgtaccagaaaacagttaaagagtctgacgatagctgctgcagactgattccagagggatatatcctcaaaagtacaatgaactgccaacaaatccttgatcaaacattttcaattgctaacagtgccggtgttgacgcaaatatatttgtctgtaaatttgaacaaagcgcatgcttacttccgtctgcttccttagttggtaacgatttcgttcattacgatcttacgcctaagcccatcaagctcgattcttaaagccttaaccattgtgtcgtgataaacacggctcaccttctctccattgcatggcagaggggtgagtgtgttagccatgaaattcatgaactcggttcgaccaggggcttgcgccccgcaagtctttaatgcctgttttgctaacaaaatgcgggcctcagtgcctgcatttggctctatctgctgcaaacgtttagcgtcttccagcaacaatgcgatcacatgcttcaaattctgctcattcatctattctctccactgaaatcatccgctaacgaatcatcccggtcttcgtacgtaccgggcgggctacttcgtgggcgtcctgcctgtttgttgtttctcttgggtacattatgtatctcaaaggtacattgtcaagtataaaaaaacctgccgaagcaggttcataaacattgattaggctttgattttgtatcttcttggttttcctgagaaaatcacagtaccaattatagagcaattaccgttgatcttaatgtaaggctcaggccagtttgggtttaacgctttgagataacgctgtgtcccatcttctatcaaccttttgaaggtggtttcacctgtatcgtgcatcaatgcaataacgtcgtcaccgtggcaggcaggtacttcaggatcgacaaaaatcatgtctcccgggcggtactcatcaatcattgaatcacctattacccgcaagatataagtcatttccccacagggtacagggcagggatacgtttctgctgtgctcaaatcaacctcagaatatccaacttctttccatgctccggcctgtacccatgatatgacagggactaatgtgatttgtttattagtgattgaaacatcaggtttttttgtgatgttcgttgtctggtgttcttgatcgagccatcctacaggcaggtcgaaacatttttcgatgtgtcgtgccatgctgtcaccgatatttttagtagcaccatctcccataaacctgctggtctgggttggctcgcgatcaatcatagtggcaaaggaagaattcccgccaacaccatctctcagttttctggcgttagaccgccggatgtcatggattgttttcataacgaaattaaaacccttgtaccgttaaggtacaagtatcttgaaggttcatttcaatcatgtaatatgtacaccggaggtacatattgtatgaaagcgtattgggactctttaaccaaagaacagcagggcgagttggccggaaaagttggctcaacacctggctacttacggctggttttcaatggctataaaaaagccagttttgtgctggctaaaaaacttgagcaatacacatcaggtgcaattacgaaatctgacttaagaccggatatctatccgaaagattagcagaacactttcaatttttaaccacagaacgatgaggctaatcgtgggtaagcatcactggaaaatagaaaaacagcctgagtggtacgtgaaagctgtcagaaaaactatcgcggcgttgccgagtggttacgctgaagcggctgactggctcgatgtaacagaaaacgctttattcaaccgccttcgtgcagatggcgatcagattttcccgctgggatgggcaatggttttacagcgtgctggtggcactcacttcattgctgatgctgtggcgcagtctgcaaatggcgtctttgtgtctcttcctgacgtcgaggatgtggacaacgccgatattaaccagcgtctgctggaagtcattgaacagatcggcagttattcaaaacagattcgttcagcaatcgaagacggtgtagtggaaccgcatgagaagacagcaattaacgacgagctgtatctctcaatttcgaagctgcaggagcatgcagcacttgtctacaaaattttttgcatttcagaaagtaatgacgcccgcgagtgtgcagctccgggcgtcgtggcgtcgattgcttctggttgtggagaaactaacgcatgaacagtttaacaacacactaccgtcgctcgcaactgattgcgcttcctgtaccgggtggaaaagcgaaggtggaatattgctatgcagtgaatgtaccaggtgacagggaaattgtaacccacagctttgcagagtgggctgtgggtgatttcaaccggcagaaggagacagtcctttgcgacaagttaaccgctggttcaaagatcactacggagtgcccgtcagagtcattcgttgggagccggaaacacaacgggttatctacctccgcgaaggttatgagcatgaatgcttcagcccgctcgaacagtttcgtcgtaaattcagggaaatagaggtcggtcatgagcactaaattaaccggctatgtatgggatggttgcgctgcatcaggcatgaagttatccagcgtggcaattatggcccgcctggctgatttcagtaatgacgaaggtgtgtgctggccatcaattgaaaccattgcccgtcagattggcgcggggatgagtaccgtcagaacggctatcgcacggctggaagcagaaggctggttaacgcgtaaggcgcgtcgccagggtgatggttcatcaccccactgtgccgtggtggatgaatatcacgagcacgccacagatgcgctttacaccacgatgcttaccgggatgggggcgcgacgccagccactgatgtgggccattaccaccgccgggtacaacattgaggggccgtgctacgacaaacggcgggaagtcatcgagatgctcaacggctcggtgccaaacgatgaactgttcgggatcatctataccgttgatgaaggtgacgactggaccgacccgcaggtgctggaaaaagccaatccaaatattggcgtgtcggtttatcgcgaatttttgttaagtcagcagcagcgtgcgaaaaataacgcccgtctggcaaacgtctttaaaacaaaacacctcaatatctgggcgtcggcgcgttcggcgtatttcaacctggtgagctggcagagctgcgaggataaatcactgacccttgagcagttcgaggggcagccgtgcattctggcctttgacctggcgcgtaagctggatatgaacagcatggcgcgactttatacccgcgagattgacggtaaaacgcattactacagtgtggccccgcgtttctgggtaccgtatgacacggtgtacagcgtcgagaaaaatgaagatcgccggacagccgaacgctttcagaaatgggtggaaatgggcgttctgaccgttaccgatggtgcggaggtggattatcgctacatcctcgaagaggccaaagcggcgaacaaaatcagcccggtcagtgagtcacccatcgaccccttcggggcgaccgggctgtcacatgaccttgctgatgaagacctgaaccccgtcaccatcattcagaactacaccaacatgtccgatccgatgaaagagctggaagcggcgattgaatcggggcgctttcatcatgacggcaatcccatcatgacctggtgtatcggcaacgtggtcggcaaaaccattccgggtaacgatgatgtggtgaagcccgtcaaggagcaggcggaaaacaaaatcgatggtgcagttgcgctgattatggcggttggcagagccatgctgtacgagaaagaagacacgctgtctgatcacattgagtcctacgggatccgctcgctttaactgaggtaattatgatcatgctgattctcgcgcctctggtgggcgtgctgggtgcgcttttgctggcgtatggtgcctggctgatttatcccccggcgggttttgttgttgccggggcgctgtgcctgttctggtcgtggctggtggcgcgatatctcgaccgtacacagtcgtctgtcggcggaggtaaatagtgttcttttcgggattatttcaacgaaaaagtgacgcaccggtgaccacgccagcagagctggcggatgccatcgggctgtcgtatgacacctataccggaaagcagatcagcagtcagcgggctatgcgactgacggcggttttttcctgcgtcagagtgctggcagagtcggtcgggatgttgccctgcaatctgtatcacctgaacggcagcctgaagcagagagccaccggcgaacgtctgcataaactgatctccacgcatcccaatggctatatgacgccgcaggagttctgggagctggtggtcacctgtctgtgcctgaggggaaacttttacgcctacaaagtgaaagcatttggcgaagtggctgaactgctgcccgtcgatcccggctgtgtggtatatgcgctgggaaggtgtcagcgatggcctgaaggtgaccgccgggagtgttattcagcgcgatgacctggtgcagtacacgacaactgacgatgcaaccagctccggtggtgtcctgcgcgtgccgatcgcctgctcaagtgcaggtgcggtcggtaacgctgacgacggtacggcattaatcctggtcacgccggtgaatggtctgccgtcttccggtgtggctgacaccctgacaggcggatttgatactgaagagctggaaacgtggcgcgcccgcgtcattgagcggtattactggacgccgcagggcggggctgacggggactatgtcgtctgggctaaagaagtgcccggcattacccgcgcatggacataccgtcacttgatgggaacgggaactgtcggtgtgatgattgccagcagtgacctgattaatcccattccggaagaatcaacggaaacggcggcaagacaacatatcgggccactggccccggtggcaggctctgatttgtatgtgttcaggccggtggcacatacggtggattttcatatccgcgtgacgccggacacaccagaaatacgggctgccattaccgcggagttgcgttcgttcctgctgcgtgatggttatccgcagggagaactcaaggtatcgcgtatcagtgaggcgatttccggtgcgaacggggaatacagccatcagttgcttgcaccggtggacaatatctccattgcgaaaaacgaactggcggtactggggacgatttcatggacgtgacaaacgatgattacatccgcctgttatcggcactgttgccgcccggtccggtgtggtcagccagcgatccggcgattgccggtgcggcaccgtcattaacccgtgttcatcagcgtgcggatgccctgatgcgggagctggatccgcgcaccaccactgaactgataaaccgctgggagcgtctgtgcggtctgccggatgaatgtattccggcgggaacgcagacccttcgccagcgtcagcaacggctggatgcgaaggttaacctggcgggcggcatcaacgaggatttttatcttgcacagcttgctgccctgggcagaccagatgccaccatcacgcgatacgacaaaagcactttcacctgctcatcggcctgtactgacgcggtgaatgcgccggaatggcggtattactggcaggtcaacatgccagccaccaccaactccacctggatgacatgtggcgatccctgtgattccgcactgcgtatctggggtgacaccgttgtcgagtgtgtgcttaacaaactctgcccgtcgcatacctacgtaatttttaaatatccggagtaatccatgcatcgtatagacacgaaaaccgcgcagaaggataagttcggcgcgggtaagaacggttttacccgtggtaacccccagaccggcacgcctgccaccgatctggatgatgactactttgacatgttgcaggaggaactttgcagcgtggtggaggcatccggtgccagcctggagaaggggcggcacgaccagttacttaccgcacttcgcgcgctgctgttaagccgcaagaatccgtttggcgatatcaaatcggatggcactgtgcaaacggctctcgaaaaccttggtttgggagaaggagcaaaactcaatgcagcaacggctacattaggacgcaccggtttcatagctataccggttatgattggtggtattgagcaatcagtaatcattcagtgggggtggaatgccgcaaaagcatctgcctctgggggggatggaaatacagttgtattcccggttgcgtttaataatgcctgtgttgccgttgttgcaaattatgacaatgtcagcgcacctatcaatgcagtggcaacggggggatatacaaccacttcgtttttattacggtgcgcagctcaaacgggtagttattactataactggattgctattgggtattaagatgaaaatatactgttgcttaaataccgttggtttttttatggatggctgtggcgtcattccgccagattctaaagaaataacggcagaacactggcagtcattattaaaatctcaagctgaaggaggcgtgatcgatttttctgtttttcctccttctattaaagaggttatccgtactcatgatgatgaagtcgcagatgcgaactttcaaaagcagatgcttatctctgatgcaactgattttatcaatagcagacagtggcagggtaaggctgcattgggaagacttaaagaagatgagctgaaacaatataatttgtggctggattatctggaagcactggaactggttgatacatccagtgcgccagatattgaatggcctacgcctccggcagttcaggccagatgacatccggcgcggtgctggtatctgttgccgtcaccgcgtcaatgtaatccagcacagcgttaagtctggttgtttctgcctgcgtcagtttacgtccggcctgcaatttcagttgaatcagactaatggaagccattgcagcatcaatcagtgactggcgctgtgcttctgccgcgtctactgcggcgctatgctgtgcttcagtatcggtcacccatttctcaccatcccatttatcgtatggagataaaggggcgatagtggttgtattttcagggtaatcacccggagctttgatttcttttgattctccagttttggtgctatagaccgtttcaccgcgatggtctggcacatattcccatgagttaaaatctgcagaacggcagattgcataaccagccttatgtgtaccaggggcatctaaacaggaacatgccggaatgccgacaccaacggcaagatattcatttgaagtggaaatatattcccgtgtttcaccatcgtagttataaacggtaacatcccctgcctttgttgcaataaggtcactatttaatattgctttatgcatcaggctgccctcacgatatagttaaatgcaatattacgcggacgcgtttctgaggctgcggcacctaaaccatccactgattgtttatatgttttaaaggttccataatccggggctggtaatccggcatcgtttgtgtttcctcttttgataatgtcagtgccactatttacccatatttcatcaaaatagaaattaatcgttgcatcagtcacaatcgtggatcttgacggtaatccatgagcatgatcctccgttgcatacccctgaatacttaaaatagagcgacctgtatcaatcccccgcccgtcatcccagccacgaataaactcaccacgtaaatcaggcaatttatttgtcggataagcctttgccagttccgggtattcttcagcagaaaaagcggcaccattgcatttcagccagcctgttggcggagtggctgaaggccacggaaccgggacaccaacaggtaatgcagagccttctcccaaaccaacgtttatgaaaatgaagaaataacaagcaaatggcatcattcctgcttttaccagggggatttaacatgcttattggctatgtacgcgtatcaacaaatgaccagaacacagatctacaacgtaatgcgctgaactgtgcaggatgcgagctgatttttgaagacaagataagcggcacaaagtccgaaaggccgggactgaaaaaactgctcaggacattatcggcaggtgacactctggttgtctggaagctggatcggctggggcgtagtatgcggcatcttgtcgtgctggtggaggagttgcgcgaacgaggcatcaactttcgtagtctgacggattcaattgataccagcacaccaatgggacgctttttctttcatgtgatgggtgccctggctgaaatggagcgtgaactgattgttgaacgaacaaaagctggactggaaactgctcgtgcacagggacgaattggtggacgtcgtcccaaacttacaccagaacaatgggcacaagctggacgattaattgcagcaggaactcctcgccagaaggtggcgattatctatgatgttggtgtgtcaactttgtataagaggtttcctgcaggggataaataaagttaaagacactttgtgtacaaaagaaagtaaaacaacagcaacttgttgcaattttatcaataaaagtagtattgtcgtgaaaaattgattaaagattaatattatgcatgtttttgataataatggaattgaactgaaagctgagtgttcgataggtgaagaggatggtgtttatggtctaatccttgagtcgtgggggccgggtgacagaaacaaagattacaatatcgctcttgattatatcattgaacggttggttgattctggtgtatcccaagtcgtagtatatctggcgtcatcatcagtcagaaaacatatgcattctttggatgaaagaaaaatccatcctggtgaatattttactttgattggtaatagcccccgcgatatacgcttgaagatgtgtggttatcaggcttattttagtcgtacggggagaaaggaaattccttccggcaatagaacgaaacgaatattgataaatgttccaggtatttatagtgacagtttttgggcgtctataatacgtggagaactatcagagctttcacagcctacagatgatgaatcgcttctgaatatgagggttagtaaattaattaagaaaacgttgagtcaacccgagggctccaggaaaccagttgaggtagaaagactacaaaaagtttatgtccgagacccgatggtaaaagcttggattttacagcaaagtaaaggtatatgtgaaaactgtggtaaaaatgctccgttttatttaaatgatggaaacccatatttggaagtacatcatgtaattcccctgtcttcaggtggtgctgatacaacagataactgtgttgccctttgtccgaattgccatagagaattgcactatagtaaaaatgcaaaagaactaatcgagatgctttacgttaatataaaccgattacagaaataaaattatttattaaagtcacatttaagacgtaataccctacagggtaaaaattttctctgatcttaacttctgcaaatgttaactgctatttttatgctaaaaatggttatcaaaactcaaaaacacatgtttataatcaatgagttatagaaatgctaagggctaatgagttatatgcaaattagtaaaattatgttgctatgtcagatagttacgatttagtcatctaactaatgctgcgccatatgggttggactgaagcggctgacctgattgttaaaggtatggaaggcgcaatcaatgccaagaccgtaacttatgacttcgaacgtctgatggaaggcgctaagctgctgaaatgttcagagtttggtgaagcgatcatcgaaaacatgtaatctctccatgtgttaaatattgaaacgggcgtataacacgcccgttgttttatttatgtggatattattaatagcatatcgagcatatttatatgaagcccattacttgagcccatatgggcatatttttataatgcaactattatgtaaacatttatttgttattttgctttctcctggaggacactcttgactgcttttgagtaaactccataaatccttgttgaatggtgcgatgtgataaatagtaataggatattctttatccttaaggataataccagacttaaccggtgtaaatatactgccaggagggagaaatatagtagattgataccagatgatcattttcatattaccccatatggctgaaaaagatataccacatgtaggttgaattaccgtgtcaattactatccacttcatttgttatgtcttatcccacggtatttaatatggttcattaggatgtttatttcttgattttgcatatgagtatattacccccccctcaaaaaaataaattaattaaaatgatggcttatataaaataaaatttaaagcaaggaatctcaatggatgttaaacaaaatgagattttgtgaaagcaataaattattgacttcgttttagatttgtttagctataatgttatacattcaaatgactgaacatcctgtaattaaaacatagcctttatgctactttgtgccaatttgctaaacattatggttgcctttttatataacgataataatgaatataagcatgacatgagaataaggtttcaatttttgagttatataggaatgatttaacctgttcctggctaaaatacatataaccggatgatgactaaaccaaaatacatgtgcgttaagtattgaaacggacgtgtggcacggccgttgtttttataaatatgttaaccgttataaaataacgtatcaaaagtcaagtgatcacatttcaaatatcaagttgatagtattagtctggtgattatttatgggtgacaataaaaagacagtattaatcatccatagagatagtctctgcacttttatttccattatgctaatgccttactgaattatgaagcatttcttaagtatccaactttagctagattaatggtttattattttctacatcttcaatatataaaagcgtattatcaatggcgtagtaactgcgtttgttatgattaacatcagtaacccaccggaaaacgcccgcgcctgccagtgttgaacagtattcccgaaatgtagattttccgcaaatatgaagcaatgcggcctcttttattttagcagggttcttggtcgtactaacttttaacaggttcctggttcctcttaataacaaaaccgtatcatcgtgagtaataattctgatgttatccgtagccagataataaatgtaatgtgcaatacggtgatgttttaattctgaataaaaccaggagaagttttgctcttttctcacttgctcaaacatcttttgaaaaacaacgacctgatccatcaggataataacctcttgttagttgtgagactgcgtagtgtgcacgatcggttttaccacttcaatctggtctgtcctttggctgtgatatgtacagagtgtgatagagggaatatctgaattctcccggtgagcattttgcaacggaccagctccggtacaaacgctgttgtgggttcagattataacattctgtctaaggggcgggataaaggtgaaattagggggcatgaaagatgactttataaccttgctcaccccagtgttgtaaaagttcgttttgccttctcgttggtgccatgcctgtccagacaatcaatgtttgcgtcgggaacagttccgggcgcggcgattcaatgggatcagcaagaacagaaatgtgccatcctgacaatgataaacgccatgcttccagccacaatcgtgctctctcttcaacattccacgccatcagaatggcttctttaccgggcttacggcgcatttcgaaaagcgaggttgctgcgtattcaattaatgcgccgtcaaacatactgctcataatgcgggaggtgttgtgatcaagcacgagacgctggcgaacaggaaggtaaacatgattaatcaattgatctactgggtactctcgacccagtgaaataattctcgcgcgtagtttggcaggattagccatgcgaagaattgacatcatctcttcttgcaggcggctccagtcatcttccgtatcctggctggtggtttccagtaatgctttaactttgcctacagggacgccattacttatccaacgcttgatctcttcgatgcgttgtatgtcttcttcatcaaagagtcggtgtccgccttcactgcgctgtggttttaacaaaccgtagcggcgttgccaggcccggagagtgacaggattaatcccgcaacgttcagcaacatcaccaatgctgtaataagccacaattcctccttgcggtcacaaatctccgtcgcctgtacacgacccaataatactttgtacaatatacgctaaaattgtacaaagtataaataagatttcagctaaattggatgaaacattatttttaatgtggattaaatttaaacgtaacgtattcattttcacgatgatttactgaaatcatgtgaaagaatgtgctgaaaattattttttctctggccacgctatggaagggataccattcaatttagctttagcaaacagatctccctgaaacatctcaattcctgcggattcaagccacatccactcttctggtgttgccacgcccatagcactgacttgaatttcaagtgatgtacagcattttatgatcgcctgaataattgcctgccgtggcccacttttatgaacattggtaatcaattcctgactgattttaattctgtcaggctggaagcgtgacaggagtaacaaaccagcaaaacctgcgccaaaatgatcaattgctacactgataccagcagcctttagcgatttaatcgcttcggcaaactcatcaaaccgagatatgacttcactttcagtaaattcaacgatgatttgttcaggcaccagagcattggcctttatttcattaagtaaaaaagagactgcgtcaggttcgttaaccagggtcataggtaatagattgattgaaatcattttatcaccgagctcaagtgcgtgtgccatcgtgaatgcaagcgccttacttttgagatccgctgtgtagatttccccgtctttacgctgcccaaccgctatggctgatgggctatcttcatttttttgcacaatggcttcaaaagcgattatccgccgcgataagggatcgacaataggatgaaaggcaaagtggtcgtttatagttggtgaaagggcacaggaatcaagttctttatcagatccgtcagcgataaaaagccaggagtcttcggcagggatctcgaaataggttgattgttcggttgcaaggacaaaagtacgaaaaaattgtagcgctctgtcatcataagttagctgaaattttgatgtgcctttgtcgaatacggcctgtaaaacgtcatctcgctcgtgcaggcgcaaatcaaataattccattcccgctttgccaaaacggcgagcaggcgcgtaatcgcacagcagctcaacaatattatagtgccgtggatcctggcatatagcccgatatatcattttaacctgttcttccggaccttccagaagctggaaaaaatgagaaccattaaacagtaagatccctgttacgtcagactgcatgttcctgcgatttgctatcgaaaccatttcttcgatttttttgacaggttcgtcgtcacgtatatggctacgataaataagggtggtaagcattaacaatccagggtaatgggtgaggcgagagtaagacggtaacagacatatcttcttgtgtctttcttttaataccaaaacataaccgtttctttacattgataaaaaatggaaaaagttgaacactagttggcgaaaaatcttgtatagattgtcagttaaatgatgcaatatgttttatcataacacattgttttatatgcattagcactaattgcaaaaaattaatttatcattctgtacacatatttcgtacaagtttgctattgttacttcacttaacattgattaacatttttaacagaggcgtagcatgcatcaaaattcagtgactttagattctgcgggagcaatcactcgttactttgcaaaagctaacttgcatactcagcaggaaactctcggggaaattgtgactgagattttgaaagatggacgtaatctgagtcgaaagtcgctttgtgccaaacttctttgccgactggaacacgcgactggggaagaggaacagaaacattataatgcactaattgggttgctttttgaataatgcaacagcctgattatttaacaggttagctatgaagtcgttatgaagacatctgataatgaacgtataaaatatgaaattactggccaggcggtgctccagatactgcgcatgaagataaatttttcattgcagactcttattaagcaattactcgtaatgaaatcggctgaggaagatgctttccgacgcgatttaattgacagcataattcgtgattttagcaatagtgattcaggagggccaaaccgaagaacagcgacagctgacaataaaagtatgttcaatggtaagaaaataaacagaatacattaaaatttcataagtaagatgagaggttaccatgcttgaagatactacaattcataatgcaataactgataaagcgttagcaagttactttcgcagttcgggtaatttgttagaagaagaatcagcagtgttagggcaggctgtcaccaatttaatgctttcaggcgataatgttaataataaaaatattatcttaagtctgatacactccttggaaacaacaagtgatattctcaaagctgatgtgattagaaaaacactggaaatcgtgttgcgatacacagctgatgatatgtaacttctaattattaagtataagtttatagaaaactcattcatcttatttttgtctgtcgctttagactatacacagcataattttattgggttaatatttctacgaggctgacatgaataattcaatcccagagagatttatttttcaatgtgctttgtttaaaaatctcgagagggaggtgttcatgacgcatgggtatgttgatagtcatattattgatcaggctttacgcttgcgtttaaaagatgaaaccagtgtgattctttctgatctctatctgcaaatattgcagtacattgaaatgcataagactacactaacggatatcattattaatgacagggaatccgtgctctcttagaacttgagtaaggttttagaataaacatcagctgtatcaccatgctgatgcaaagtgagcatttcaggcgttatgctttcttattatgtccgcaatatcaggtgtcaagaatggagagttctcgctctccattcttgacgcctgatatcccgcctaacttattttgtactgcctacattatgctcaataattaatgggttagatcaagatggagaaaattttatcttcggcgtggatatttcttatgctctctaccatgctctctgtagatgccagcgcgagcgaatgaatggcattttcatgtattaaaccctttggccgggacaagcaaatgcgcaatacactcatacccatcctcgttgcgatatgcttgtttattaccggtgtcgctattttgaacatccagctctggtattccgcaaaagcagagtacctggcgggagcgagatatgccgccaacaatatcaatcatatacttgaagaagcgtcacaagcgactcaaacagcggttaacattgccgggaaggaatgcaacctcgaggagcaatatcagcttggcactgaagcagctctgaaacctcacctgcgcacaatcatcattctcaaacagggaatagtctggtgtacatccctgcctgggaatcgggtcctgttgtctcgtattcctgttttcccggacagtaatttactgttggctccagcaatcgacaccgttaatagattacctatcctgctctatcagaaccaatttgcagatacgcgcattttggttacgataagcgatcagcatattcgtggggcacttaatgtacccttgaaaggggtaaggtatgtattacgcgtggcggatgacattattggaccaacgggtgatgtgatgacgcttaatggacattatccctataccgagaaggttcactccacaaaatatcatttcactattatctttaacccgccgccactctttagcttctacagacttatcgataaaggctttgggattttaatatttattctgttaatcgcctgcgccgctgccttcctgcttgatagatatttcaataaaagcgcaacgcctgaagagatcctgcgacgggcaataaataatggggagatcgtccctttttaccaacctgtggtaaatggtcgggaagggacattgcggggagttgaggtgttagcccgctggaaacaacctcacggtggatatatatcacccgcggcatttattccacttgctgaaaaatccggattaatcgttccgcttacgcaaagcctgatgaatcaggttgccagacagatgaacgctatcgcgagtaaattgccggaaggttttcatattggaattaattttagcgcttcgcatattatttcgccgacgtttgtcgacgagtgtttaaatttccgtgacagttttacccgccgcgatttaaaccttgttctggaagtcaccgagcgtgagccattgaatgttgatgaaagtctggttcagcggttgaacatactgcatgaaaatggttttgtcatcgcactggatgatttcggtactggctactcagggctttcttatcttcatgacctgcatattgattatatcaaaattgatcacagtttcgttggccgcgtaaacgcagacccagaatcaacccgaattctggattgtgtattggatctggcgcgtaaactttcgatcagtatcgtcgctgaaggtgtcgaaacgaaagaacaacttgactatctgaaccaaaattatatcacatttcagcagggttattatttctataaacctgttacatacatcgacctggtcaaaattatcctttctaaaccgaaggtgaaggttgtggttgagtgaaaattgatcagtaaggccatagtgcggtgtaattatagacagctaattagctcgttgcctcttgttactattgttcattattttgtttgctataattgtttgaaagttttgacaggattgccattagtagcatgaacaatagtaataatctggattatttcactctctatatcatattttccattgcatttatgctgatcaccctcctggtcatccttattgcaaaacccagtaccgggctgggagaagtgcttgtgacgataaatttgcttaatgcccttgtttggctggcgatcaatctggttaatcgattaagagaaagactcgtcaaccacagggatcagcaataatctttcagtttctcactgtcagtatgcggctgaatgggttgctggcagtgaacgcctggatcattgaaggaaaggcattattgcgcaaatagttgtcaaccctggtgttatcacggttgtttttatatatcaccgaaataatcctcatcgcaactattaacaattttgatgtcgaagagttatttgttaaacaaaatcgtcacctcaaagtgatcaatgtcatgaaaataaggtgaaaaatgataatgccgacttatttatcatttatatattgtcgctgtttatctatttaaattttttgtgcttttgtttttgtctttaccctccgttttggtaatctgagctcataggttatttgaccaggaatgtttgttaatccaatgaatggatggttaatctatgaaactgaaaaaactccccgggtttagtttgggacttattgctctggcggtgggtaatgcatatgcaacacaattgttggatgattatagtataatttcctatatgactgatgaagaatcgccgattgaaatcaaagataataatccgataagtaatggagagtatctaaccactgaagacgaaagccatgctgtgaaagtggatgacggtgtaactggatatataaataatgccagtgtgatgactagtggtgatggatcttatggtatttctgttgatagtcaaaacaaagtattatatataagcgatagcgatattaagacctctggaagcgtatctgacaaagaaaatggagggataacagccagcgcagtagtcagtgaatttggtggcaccatctttatgaatggtgataattcagtcgagtcgggtggggcatattcagcgggacttttaagccaggttaatgattctgaaaagatggtaaataacacccgtcttgaaaccacagataaaacgaacattgttacctctggggaaaatgcagtaggtgttcttgcatgttcaagtcctggagagtctcgaacatgtgtcgatgctgtagatgatgaagttagtgattctaacagttacgaagttattagccgtgctgatttaaaaatgaatggtggttccataacaactaatggcattaatagctatggtgcttatgctaatgggaaaaaagcatatattaatttagattatgtggcacttgaaactgtggctgatggaagttatgcagttgctattcgacaaggtaacattgatataaaaaatagttctattacaacaacaggcactaaagcccccattgcaaaaatatacaatggtggagagttatttttttccaatgtcaccgcggtatcaaaacaagataaaggaatatcaattgatgcatcaaatatcgattctcaagccaaaatagcactattaagtgttgaactttcaagtgctttggatagtattgatgttaacaaaactacaacggatgtaagtatccttaatcgaagtattatcacacctggtaataatgttctggttaataatactggaggtgacttaaacataatttcgtccgactctattctaaatggagcgactaaactcgtcagcggcacaaccacgctgaagctttcagaaaatacaatctggaatatgaaagatgactccgttgttacccatctgactaattcagacagtattatcaatctttcgtatgatgatggtcaaacatttacccaaggaaaaacattaaccgtaaaaggtaattatgtcggtaataatggtcagcttaatatccgcaccgtattaggtgatgataaatcggctacggacagacttattgttgagggtaatacttcgggttcaactaccgtctatgtgaaaaatgctggaggaagcggcgcggccacgctaaacgggatcgaactcataactgtgaatggcgatgaatctccagcagatgccttcagataaggtgatgcaaggattgcagctggagctttcgaatatcaactaaaacaacaaggcaaaaactggtatttgacaagttatcagtcagtgaatgaggaggataacagctcagagggaaattcagaatcaacagaaacgcctacccccgtcctgcgccccgaagctggaagttacgtcgctaacctggcagctgctaacactctttttgttatgcgtctgaacgaccgtgcgggtgaaacgcgctacatcgatcctgtaactgaacaggagcgttcaagccgactttggctacgtcaaattggcgggcataatgcctggcgtgacagcaacggacagttgagaacgacctcgcatcgctacgtctcgcagttagggggcgatctgttaaccggtggttttaccgatagtgacagttggcgtttgggagtgatggctggttatgcccgcgactacaacttaactcattccagcgtgtcggattatcgttcgaaagggagtgtcagaggctatagcgcagggctgtatgccacctggtttgccgatgacatcagtaaaaaaggcgcatacattgactcctgggcgcaatatagctggtttaaaaactcggtgaaaggggatgaattagcctatgaatcctatagcgcgaaaggtgcaaccgtctcgctggaagcgggttacggttttgccctgaataaatcctttggtctggaagcggcgaaatatacgtggatcttccagccacaggcacaggctatctggatgggcgtcgatcataatgcgcacacggaagccaatggctcacgtattgagaatgacgcaaataacaacatccagacccgactcggcttccgcacctttattcgtactcaggagaaaaacagcggtccgcacggtgacgactttgaaccttttgttgaaatgaactggatccataacagtaaagattttgctgtctcaatgaacggtgtgaaagtcgaacaagatggggcgagtaatttgggggaaattaaacttggcgtaaatggcaacctgaatccagcggccagcgtctggggaatgtgggcgtgcagctgggtgataatggctacaatgacaccgcagtgatggtgggcctgaaatataagttctgatcccgccgttagctaaaaaaccgcgtcgtattcatcgacgcggtacatatgaaatattattttttgccgatagcacgcatggtgtcatcaattgccgtgatcaacagcatttgcgggtctttagcgcaaacctgattcagtttttctaccactttggcgctcagttccggagattgctcaatttttaaatcacggctggcaacgctggcattacccattaccgcaacaatttctgcaacctgtgcgctgtcagtttttgccatttcgttggcttctgcgcaagtaatataggtttctgacggcaaaccgtttttaatattgtagtcctgcgcccaggtcattggtgcgaaaacaaacaggcccgccagtaaagcaaattttttcatcatcattccttatttcattttacccagaattgcaccacccgtaccgccaatcacggcacctttaatcgccccttcgaggccattgccggtcagaacgccagtgacagcaccaacggcggcacccacttttgcacctttacgcgcatttttaccgtcgcggcctttttctgttactgcaccaacaccagcgccaacagctgcacctttcagtacgccattaacaccattgccagtaagtaaaccaacgcctgcgcctagcaatgcacctttcgtggtgcggttcatatccgccatcgctggcgtggagcagaacaatgctgagataagcccgaaggcaagtatttttttcttcaacttagatgtccggtattaagtaagttgcacacacaataatttcgtcttcaattaagatctgcttaactaaagaacgctcgctattattcagataattcaaaatgagcgtggctgtgatgataggaattatgttttttacgtgaatgagaataatcttaaatgaggaataactcattgattgacaatatttttattcaagaagtgtcattgactgttaacgcaatgttgtaaaggtaagataatctgatttatcaatattattgtgtgatttttatgtgagcagaagatattcatcagcaacgattacattagtcattttattttgccgacggcctcattgtcgaaagataagcgtacgacagtattatcagaaaagagtgattttttatccaactacacttcagcgcactgcgtgtaaaaaatgcctctttcttatgcgggatatcatcatttcatcatgatgtctttggtgagcggtgaacacaatacacctgcgctgtctcttcaggatgaatcccctggtctggtgcctgcgggctgatgttgcagcagagcttaggtcacttagacgctactatcatttatccaatggcatggaatcgaaatcagtcgatacccgcagtatatatcgtgaactgggtgcaacgctgagttacaacatgcgcctggggaacggtatggaaatgaaccctggctgaaggcggctgtgcgcaaagaatttgtcgatgataaccgggtgaaggtgaataatgacggtaatttcgtcaatgatttgtcgggcagacgtggaatataccaggcagctattaaagcctcattcagcagtacgtttagcggacatctcggggtggggtatagccatggtgccggtgtggaatccccgtggaacgcggtggctggtgtgaactggtcgttctgaccatcaacgattaaactgcgcttcggcgcagttttcgtttacaggatgttgaaagggaaaattctggggcaaaaaaagcccgccagttacggcgggaaacctcatcctatgggagaacaatgaataatgaaattgcggggttatcatctcccagtatatccatactaacaataaggttatttactcaaccaggcataaacattttgttttgtgcgtgggaacagccttaaggtgtaaagggggaggtggaaatagcaatgaggagtatcagcaagaatactcgccgctttaccacaacgtggatgagagggatgaaaaactcaaggcagagataactctgccttgaagataaatgcgcttttacagcgggcttatttcagctcttctgcttccggtaaggtcacgttcagctcaagaatagaaatatcgccatctttttgctcaagctgtacggttaccatctcaggatcaatttgtacgtatttacaaatgacctcaagaatatctttacgcaactgcggcagataatgcggttctgcatcgctgcgacggcgttcagcaacaataatctgcagccgttcttttgcaatgttggctgtgtttttcttccgcgagagaaagaaatcgagtaatgccataacttatcctccgaacaagcgtttgaggaagcctttcttctcttcttcaatgaagcggaaaggacgttcttctcccaacagacgttctacggtatctgcgtaggctttacccgcatcggcgttaatgtcgagaatgaccggttcaccctggttagaggcgcgcaatactgattgatcctctgggatcacgccgacgagtttgatgcgcaggatctccagcacatcttccatgctcagcatgtcacctctgcttacgcggcctgggttatagcgcgttaacagcaggtgctctttaataggctcttcgccattttctgcgcggcgtgatttcgacgccagaatgcctaaaatacggtcagagtcgcgtactgaggagacttccgggttggtggtaataatggcttcgtctgcaaaatagagtgccattaacgcaccggtttcaatccctgccggggagtcacaaacgataaattcaaaatccatcgctttcagatcatcaagaactttggcgaccccttcacgggtgagggcatctttatcgcgtgtttgcgatgccggcagaatatagagattttcagtacgcttatctttaattaacgcctgatttagcgttgcatcgccctgaatgacgttgacgaaatcgtaaacgacccggcgttcacaacccataatcaggtcgagattacgcaggccgatatcaaaatctatcacgacagttttctttcccttctgggccaaaccagtggcgatggccgcgctggaggttgtcttaccaacaccccctttgcccgaagtaacaacaataatgcgtgccatagaaattccttgttaaaaagggatcaatttaacggttgaacggtcaaagcgttttcgactaactgcagtcgcgccgctttgccataaaattctgctgggatttgatcactcagccagtattcacctgcgatggacaccagttccgccatcaggttcgtacaaaatatttgcgtttcccggtcaccacttgcccctgccagcgcacgaccgcgcatcatgccatagacatgaatgttcccatcggcaatcaattcggccccagcgctaacgtggcttgtaacaatcagatcacattgtggagcataaatacgctgaccggaacgcaccggggtatctattaaacgcgtttttgtgaccggcgttgtattttgcgctggagcctgcggtgtgggagctggacgtggcgctttttcctttccttccgtcaggataggcagccccatcttttcaatttcggctttaagttgcgcatctttgcagccacttacgccaataacccgcaaaccggttgccgaaaccgccttatgcatcgctgaccagtttaccgggtcttccagtgcactgacgttgagtacaacgggggcatgttttaaaaatgcgggggcctgagcgattttgtcttccagcgcctgatggataaccttaggttctgcctcatgcagatgaaccacagataaagtgaagctactgcctttaagctcgattggcgtgtttgacatcctggccttactcaattagctattaatcatcgccagcgcgcgatgatgttccgaagactataaggcatgttatagtctggattatattgaggcaagtcaccctcccatttattcagagtaaaagtctattctgtgataaatggcgctgattcatagcttaaaaaatacccttgtcaatcaacccattgccgtcgtacttttgattgttcttatttacgcttcctttttccgcaccctaatcgtgacagcatctccagacctgtttaaatatccagtattgaggcaagtgtattttttcaccacgccaggctttcttaactttccattttttgcggcatcattaaagaacagatacccgttatcttaatatccgccacagaattgctctatcatagaaaccgcagaagacgtctgatacttctgtcaggtcatcgtaactcgtccaggtcagcggttttgattacggattgatgatgaaatgagcataagtgttgtacggttggattatcaggatgtgctatgaatatgatgcgtattttttatatcggattgtcaggtgtggggatgatgttctcatcaatggcgtctggaaatgacgctggcggacttcaatctccggcgtgcggcgttgtttgcgacccgtatatttgtgtgaactcagatggcatttccccagagttaacaaggaaatatctcggcgaaaaagccgctgaaaacttacaatcattacaaggctacgatcccagcgaatttacattcgctaacggtgtattttgcgatgttaaagaaaaattatgtcgtgatgatcgttattttggtgtggatggtaagcggagtggaaaaatcaatcaaaccaccacaaagatgttatttatgtgtcgtgagtgatgtcttgtttacattatgttctattcgtcattaacctcttgagcgacagagaggagtggggcattaacgtttatgacggggagagtccccgtcggttgacatttacttaatttgaatatcgacgttatattttttagttttgtttttacgggcgtcgtttcgggtttgcaacactcgcagctcatatttgccagaagcagggagtgagtattgtccgtgactatcgagttctggggaatatctggataaatcaactgaatcatcgattcctggcccgaagaggtaagtatcagcgccttcattagagatactcacatgcactttctgaccttttttggcatagaaggtatatgtatcgtaatcgtatccctttatttcgccggagtactgagcgctgctatggccttttctgaactcaacattgacattcttacccgcagcaaagctcgtggaggttagcagtgcaagcagcaatacagccttcctgatgctcttgattttcattggtagtctcctgttcagaatgagtacgatgaactgttataatataacaatccctaacgggagaattccagtggctttcctgcgttcggtaaaatcacgttgcggcatttttgccggggggattacttataaagggggcatggactcaacaaaccgtagaaatctacagctggctggcttgtggcgcgggtttcattgatgttagcttatgccaaaacctggcatcttaaagagtaaaagtatgttttgtgtgatttatcgaagcagcaagcgtgaccagacctatttatatgtcgaaaaaaaagacgatttttcgcgtgttcctgaggaactgatgaaaggttttggtcagcctcagttagcgatgattctgccgctggatgggcggaagaaactggtcaatgccgatattgaaaaggttaaacaggcattaaccgagcaaggttactatttgcagttaccgccaccacccgaagatttgctgaagcaacatctttccgtcatggggcagaaaacagacgacactaacaaataaccgatatccggcggtggcattatctttgtcggcgcgggttttcatatccacgataaggtgaggggaacgttatgtatcaacatcacaactggcaaggtgcgctgctggattatccggtgagtaaagtagtctgtgttggcagtaactatgccaaacatattaaagagatgggcagcgcagtgcccgaagagccagtgctgtttattaaaccagaaacggcactgtgcgatctgcggcagccattggcgatcccatccgatttcggttcagttcatcatgaagtcgaactggcggtgttgattggcgcgacactgcgtcaggctacggaagagcatgtccgcaaagccattgccggttatggcgtggcgctcgatctgacattgcgtgatgttcagggaaaaatgaagaaagccgggcagccgtgggaaaaggctaaagcgtttgataactcttgtccgctttccgggtttattcccgcggcggaatttaccggcgacccgcaaaatacaacgctgagcctgagcgtaaacggcgaacaacgccagcaaggtacgactgcggacatgatccataaaatcgttccgctgatcgcttatatgagcaagttttttaccctcaaggccggtgacgttgtgttgacaggcacgcctgatggcgtcggcccgttgcaaagcggtgatgagctgacagtcactttcgatgggcattctttgacaactcgcgttttgtaatactttttgccgcctgaaagcggcggcaaaacttgcatcgctgtgccagactggttataaggtgcgttttaacgtaatggcggaacacctgatgagcgatgtacctttctggcaaagtaaaaccctggacgaaatgagcgatgcggaatgggagtcgttgtgtgatggttgcggtcagtgttgcctgcataaactgatggatgaagacaccgacgaaatctacttcactaacgtcgcctgtcgccagctcaatattaaaacctgtcaatgtcggaactacgaacgtcgtttcgagtttgaacccgactgcattaaattaacccgtgaaaatctgccaacattcgaatggctgccaatgacctgcgcttatcgtttgctggcggaaggtaaagatttacctgcgtggcatccgctacttactggttcgaaagcggcaatgcatggtgaacgtatctctgtgcgtcatatcgcagtgaaagaatcagaagtgattgactggcaggatcatatcttaaataaacctgactgggcgcagtgataaatttaatagatgctgatgggggctttcttaatatacgtctggatgctcgccatttcgtagccctgtttttgaaagcgctctgtcataatgagagttacccgataccttattatcaacaggtaactctcaatctttaaaaaacgtctgtgtttttaaatgtgataaaccttataccttgagtacatggagagaataatcgcttatcagacttcaggtacctcaaagagtgtctttttaccgtgtcttttctgatactcattacaggtgttaatcatttttttggccgcttcttttagcaaagaaagcattaaatcatcataatcaacgtagaatctggttgtttcagtttccgtttttatctcaccgatggcggctatttcggtggttaatttcaatttggcggcatcgatatctttattcgcttgtttaaccgtgttagacagggtggtaaagaaattctgcacagattttaacttgttcttcaattctggaatcagttttccttcaactacgcccgcagcaatagaataggaaatgattaatccaaatggaccggcgacgacaccggctgcggcaccggcatatgcttccttcctgattttatctacctgtgactggaaatagctgcttttttctgaaaaatcattggttaactggctatctaacgccagcagtttcccggaagcgttgttgaaactttgtgagcttaccagcagggatttttgcgcttcattcagcttcgtgatgccgtcatccagtaccttaatgagaatgtctttctgggcggatgctttcttctcattgtactcatcaaatagcaaaatatacgctgcgagcaattgcgtcgcaacaccacaccattcatacactgtttgggttgcttcaaaatacttatcctggctatccataagtaaggttttaatatcgccgactaaaacggaggctgcctgtgaatactcctgtttaaagcgacttaactcttttatggtttcatcaaaggtctgccaggggatgacctgatcgagatatttattataaagatctaatgctccatctgcggtttcgattgcgtttttaactacttctaccgttttatctgcaacgatttcagtcataatcattcgcctctttaaatatataaattgtaatgaaactcctgttttacaactattaataaattttacttcatctaattcatagttagccgggcgggatgcgtcaatgtctttatttctattaatatgataaatatcaaacaatgtttaatgtcattatggcgaatgcttctattctattttttagccgggtgatatttttcatttctgctggatgagcgtcgtcgccagaaggccacgtgagcacaagataagagaacgaaaaatcagcagcctatgcagcgacaaatattgatagcctgaatcagtattgatctgctggcaagaacagactactgtatataaaaacagtataacttcaggcagattattatgttgtttatcaagcctgcggatctccgcgaaattgtgacttttccgctatttagcgatcttgttcagtgtggctttccttcaccggcagcagattacgttgaacagcgcatcgatctgaatcaactgttgatccagcatcccagcgcgacttacttcgtcaaagcaagtggtgattctatgattgatggtggaattagtgacggtgatttactgattgtcgatagcgctattaccgccagccatggtgatattgtcatcgctgctgttgacggcgagtttacggtgaaaaaattgcaactacgcccgacggtacagcttattcccatgaacagcgcgtactcgcccattaccatcagtagtgaagatacgctggatgtctttggtgtggtgatccacgtcgttaaggcgatgcgctgatgtttgccctctgtgatgtaaacgcgttttatgccagctgtgagacggtgtttcgccctgatttatggggtaaaccggtggttgtgctatcgaataatgacggttgcgttatcgcccgaaacgctgaggcaaaggcgcttggcgttaaaatgggcgatccctggttcaaacaaaaagatctgtttcgtcgctgtggcgtggtttgctttagcagcaattatgagctttacgcagacatgagcaatcgggtgatgtcgacgctggaagagctatcgccccgcgtcgagatttacagtattgatgaggcattctgcgatctgacaggtgtgcgtaattgtcgcgatctgactgattttggcagagaaattcgcgcaacggtgctacaacgtacccatcttactgttggtgtggggatcgcccagaccaaaacgctggctaagcttgccaatcatgcggcaaaaaaatggcagcggcagacgggtggggtggtggatttatcaaatctggaacgccagcgtaaattaatgtctgctctccccgtggatgacgtctgggggattggacggcggatcagcaaaaaactggacgcgatggggatcaaaaccgttctcgatttggcggatacagatatccggtttatccgtaaacattttaatgtcgtgctcgaaagaacggtgcgtgaactgcgcggcgaaccctgtttgcaactggaagagtttgcaccgacgaagcaggaaattatctgttcccgctcgtttggtgaacgcatcacggattatccgtcgatgcggcaggccatttgtagttacgctgcccgggcggcggaaaaacttcgcagcgagcatcaatattgtcggtttatctccacgtttattaagacgtcaccatttgcgctcaatgaaccttattacggcaatagcgcgtcggtaaaactgctgacgcccactcaggacagcagggatatcattaacgctgctacgcgatctctggatgccatctggcaagcgggccatcgttaccaaaaagcgggcgtgatgctgggggatttcttcagtcagggagtcgcgcagctcaatttattcgatgacaacgcaccgcgccccgggagtgagcaattgatgacggtaatggatacactgaatgctaaagagggcagaggaacactctattttgccgggcaggggatccagcaacaatggcagatgaagcgagccatgctttcaccacgttatacaacgcgaagttctgatttactgagggtcaaataaatatagcggcaggaaaaaagcgctcccgcaggagcgccgaatggattagcgaccgaacagatcacgttttttcgctttaaacggctgggaaatcaccaccagcactgcgacaatcaggtaagcgataaaaataccgagcagccactgcggcatttccagacctaaaaaatcccactgacgctcggcgcaatcgccagaggcgacaaacacttgcggcacccacttatccagcggcagccattccgggaaacgaaccataaaatcacaggtggcaaacggcgaaggatagagctgaagcatggtgtgctcgtaagttaactgcacaccgcggaacgcactatacaaccagataaccatcgctacataacgcagcggagttttcggggcgatcgcgccaatcagcgcagcacccagaacgccgaataacgcgcagcgttcataaatacagagcacgcaaggtttcagtaacatcacatgctggaaccacagcgccgtcagttccagtgccagagcagtaaacgccatcaacagccacgcgccccggccttgtgaacattggttcaaaaatcgcaacataatcatttccctgcaatatgcatagagtgcgcagtttaaaccaattcattcgctgcgccaccaggaggcagcaaaaataggacgcaattggacaattatcgggcgaaaaggcaaaccgggcatttatatgcccggtaagttgttatcaaagcgttgctatccagcccatttgcataaaccattcggttacaggggcaagcgtaaactcgacgcagagcaagccgacgagtgtcaggacgagggtgtaaggcagggccatccacaccatgcggccataagagaggcgaatcaatggcgcgagtgcagaggtcagcaggaacaggaacgcagcctgaccgttcggcgtagcgacggagggcagattggtaccggtattaatggcgaccgccagcagctcgtattgcttcaacgtgatagcgccactttccattgccgctttcgcttcgttgatataaatcgtccccacgaagacgttatccgaaatggatgacagcagaccgttgaaaatatagaacagcgacagctgagcatgttccgatgcctgcaacacaaactgaataattggcgaaaacagttgttggtcgataatcaccgcgactaccgagaaaaacaccgtcaacagtgcggtgaatggcagagattcggtgaaggctttaccgatagcatgctcatcggtgacaccggtcaatgatgttgccagaataatgactgacaaaccaatcaagccaacttccgccagatgcaacgccagcgcagtcaccagccagacgccaataatcgcctggacaatcagacggattttatcctgacgggtacgctggtggcggctttgatcgtcaaactgttgcaacacttcgcggactttctccggcagcgtttcaccgtagccaaaccaacgcagcttctctaccagcaggcaggttaacaggccacaaatcagaaccggaacggtcaccggcgacatgcgcaggaagaaatcgccaaaatgccagccagccgctttagcgatgatcaggttctgtggttcgcccaccatggtcattacgccgcctaatgcggtgccgacaccggcatgcatcatcaggctacgcagaaagccacggaactgttccagaaccactttgtaatgcttgtcgatatgactatcgtcttgcaggtcggtgtcttcggtacgggaagaggctacgcggtgataaataccataaaaaccgactgcaacgctgatcaccaccgccacgacggttaaggcatcgaggaacgcggagaggaacgcagccgccacgcaaaaagagagcgacagcagcattttggagcgaatgcttaacagcaaacgggtaaatatgaacagcaacagctgtttcataaaatagatacccgccaccataaacatcagtaacagcaagacttcaagatttgccgccacctcttcacggacgtgttccgcgctggtcatgccgatgaataccgcttcgatagccaacagaccaccggggagcagcgggtagcatttcagggccatcgccagagtgaaaataaattccgctaccagcaaccagcccgcgacgaaagggctgatgaggaaaattaacgggtttacgattaagaaaatgatgagggcgagtttgtaccagtcgggggactggcccaaaaaattgcgccatagcgcgcggccccaggagatctccatgatggtttcccttaccttacaaataatcaatgatgtttttatgtttaaacgcaaagcttaacggtcaggcaggagtgaggcaagtcttgatagtcaaggggaaagagatgcggaaaatgaagccttgatccctttttcttctttttgtctgctatcagcgtagttagccctctggtatgatgagtccaactttgttttgctgtgttatggaaatctcactatggtcattaaggcgcaaagcccggcgggtttcgcggaagagtacattattgaaagtatctggaataaccgcttccctcccgggactattttgcccgcagaacgtgaactttcagaattaattggcgtaacgcgtactacgttacgtgaagtgttacagcgtctggcacgagatggctggttgaccattcaacatggcaagccgacgaaggtgaataatttctgggaaacttccggtttaaatatccttgaaacactggcgcgactggatcacgaaagtgtgccgcagcttattgataatttgctgtcggtgcgtaccaatatttccactatttttattcgcaccgcgtttcgtcagcatcccgataaagcgcaggaagtgctggctaccgctaatgaagtggccgatcacgccgatgcctttgccgagctggattacaacatattccgcggcctggcgtttgcttccggcaacccgatttacggtctgattcttaacgggatgaaagggctgtatacgcgtattggtcgtcactatttcgccaatccggaagcgcgcagtctggcgctgggcttctaccacaaactgtcggcgttgtgcagtgaaggcgcgcacgatcaggtgtacgaaacagtgcgtcgctatgggcatgagagtggcgagatttggcaccggatgcagaaaaatctgccgggtgatttagccattcaggggcgataatcccttccgtttaaagagcaaacccctcaaacgaggggttttttgttgtttttacagatttcccattcttggcgggcaacgttccagcaactcgatgctgccgtcttcgttttgctgttcgagcatcacatcaaatccccacaggcgatgcacatgcttcaggacttctttgcgcccccgatccagcggtgcgcgattatgtggaatataacgcagcgtcagcgaacggtcgccgcgcaaatccacgttccagatctgaatattcggctccagattacttaagttatattgcgacgataaccggttacggatctcccgataaccttcttcattatgaatagcggaaatctccagataattatgccgatcgtcatccagcacggtgaagaagcggaaatcacgcatcactttcggtgacaggaactggctgataaaactctcatctttgaaatcacgcatcgcgaaatgcagcgtttccagccagtcggaaccggcgatatccgggaaccagtatttgtcttcttccgttggcgactgacaaatccgtttaatatcctggaacatggcgaacccgagggcatacgggttgatgccgctgtaccacgggctgttataggggggctggaagaccacattggtgtggctgtgcaaaaactccagcataaaacgttccgttactttcccttcatcatacagatggttaaggatggtgtagtgccagaaggtcgcccagccttcgttcatcacctgagtctgtttttgcggataaaaatactggctcaccttacgcacaatacgcaggatttcacgctgccatgattccagcagtggcgcatttttctccataaaatagagcaggttttcttgtggttcggacggatagcggcgcgcttcagcaaccgttttctcttcctcgcgcttcggcagggtacgccagagcatattgacctgactttgcagatactcttcgcgacttttctgccgggctttctcttcttgcagcgagattttttgcgggcgtttgtaccggtccacgccgtagttcatcagcgcgtggcacgagtccagaagccgttctacttcatcaacgccataacgctcttcgcactcggtaatatatttacgggcaaaaatcagataatcgacaatcgaactggcgtcggtccagctacggaataagtaattgtttttgaagaaagagttatgcccatagcaggcatgagccatcaccagcgcttgcatggtaatggtgttctcttccatcaggtaagcgatacacgggttagagttaatgacgatttcataggccagtccttgctgaccgtgcttatacagccgttcagtctcgataaactttttaccgaatgaccagtgcggatagttaattggcatgccgacgctggagtaggcatccatcatctgttctgaggttatcacttcaatctggtgcgggtaggtatccagccggtagagtttcgccacccggtctatctctgccagataaacatccagcaggtcgaacgtccagtcgggtccatcgctcaaacgtgtggtgtccttattcatagaatcgatcgtcgccatacgcgcacctcattgttgtcggcgctctctgtgtggagcacctcatttcaagcatagaacacctgttaaaaaccgcgtcgccggagaatttttttctttgcgatttcttattatcagagtgccactaatccgcttctgaacggaattttatgctggataaaaagggcgttcagcaggagatactaaagacgccatattgccgcagagtcagggagatgtgagccagctcaccataaaaaagccgcatgttgaataatattttcaactgagttatcaagatgtgattagattattattcttttactgtatctaccgttatcggagtggctatgcgagttgtcatactgggaagtggtgtggtaggcgttgccagcgcctggtacttaaatcaggcaggacatgaggtcaccgtcattgatcgggagccgggggccgccctggaaaccagtgccgcgaatgccgggcaaatctcccccggatatgctgcaccgtgggcggcaccaggtgtgcctttaaaagcgattaaatggatgttccagcgccatgcgccgctggcggttcgtctcgacggtacgcagttccagttgaaatggatgtggcaaatgttacgtaactgcgacaccagccactacatggaaaacaaagggcggatggtgcgtctggcggaatacagccgtgattgcctgaaagcattgcgcgccgaaaccaatattcagtatgaagggcgtcagggtgggacgctgcaactgttccgtaccgaacaacagtatgaaaatgcgacccgcgatatcgccgtgctggaagatgccggcgtaccgtatcagctgctggaatccagccgcctggcggaagtggagcccgcgctggcagaagtggcgcacaaactgacgggcggcctgcagttacccaatgatgaaaccggagactgtcagctatttacccagaatctggcgcggatggcggagcaggcgggggttaaattccgctttaatacgcccgttgaccaactgctttgcgacggcgagcaaatctacggcgtgaagtgtggcgatgaagtgattaaggccgatgcgtatgtgatggcgtttggttcttactcgacggcgatgctcaaaggcattgttgatattccggtgtatccgctgaaaggctactcgctgaccattccaattgcgcaggaagatggtgcgccggtatccaccattcttgatgaaacctacaaaatcgccattacccgtttcgataaccgcattcgtgttggcggaatggcggagattgttggttttaataccgagctgttgcaaccgcgtcgtgaaacgctggagatggtggttcgcgatctctatccacgcggcggtcatgtcgagcaggcgactttctggactggtctgcgcccgatgacgccagacggcacgccggttgtcgggcgtacacgctttaaaaatctgtggctgaataccggtcacggcacgctcggctggacgatggcttgcggttccggtcagttgttaagcgatctgctctctggtcgcacgccagcgatcccatatgaggatctaagcgtagcgcgctacagccgtggatttacgccatcacgtccgggccatttacatggcgcacacagctaaggaaacgagatgacccgtccgatacaggccagcctcgatctgcaggcattaaaacagaatctgtccattgtccgccaggccgcgacgcacgcgcgcgtctggtcggtggtaaaagcgaacgcttacgggcatggtattgagcgtatctggagcgcgatcggggccaccgatggctttgcattgcttaacctggaagaggcaataacgttacgtgagcgcggctggaaaggaccgatcctgatgctggaaggatttttccatgctcaggatctggagatttatgaccagcaccgcctgaccacctgcgtacacagcaactggcagctcaaagcactgcaaaatgcgcggctaaaagcaccgttggatatttatcttaaagtgaacagtgggatgaatcggttgggcttccagcccgatcgcgtgcttaccgtctggcagcagttgcgggcaatggcgaatgttggcgaaatgaccctgatgtcgcattttgccgaagcggaacatcctgatggaatttccggcgcgatggcgcgtattgagcaggcggcggaggggctggagtgtcggcgttcgttgtccaattcggcggcgactctgtggcacccggaagcgcattttgactgggttcggcctggcattattttgtatggcgcttcgccgtccggtcagtggcgtgatatcgccaataccggattacgtccggtgatgacgctaagcagtgagattattggtgtccagacgctaaaagcgggcgagcgtgtgggctacggcggtcgctatactgcgcgcgatgaacagcgaatcggcattgtcgccgcagggtacgccgacggttatccgcgccacgcgcctaccggtacccctgttttagtggacggcgtgcgcaccatgacggtggggaccgtctcgatggatatgctagcggtcgatttaacgccttgcccgcaggcgggtattggtacgccggttgagctgtggggcaaggagatcaaaattgatgatgtcgccgccgctgccggaacggtgggctatgagttgatgtgcgcgctggcgctacgcgtcccggttgtgacggtgtaacttgttgtaagccggatcggaggcaacgtcttctgggtgcaaaaaaatcatccatccggctggtcagcaactgtagttgttaatgtgacagagccattgcccatgatagtgtccattaaaaggatggacactatttccccggaacctgaactcaccgcacaggcgttctacataaaacgcttacgcttcattgttgactcgaactcgacttcagataaatcacgctttacccttgatggagcctgtacatagatttgtgtaattgcctgattttgatatgttcaattcaacatcaaatgaaggttaaattatggacgacaaacaattgcaggctcaggctgcgttcagcaaagcatcgcaaccggcgatagatgcttcattaaatttaagattcagcttcctcttcagccacccgtacgccaatcttcaacacttcattatcttctttctcggccaccgtccagatcatcccggcaaactctacctggtcaccgacaaccggtgccgcgcctaacaactgctggacaatttcacccagcgtttgctgcttatcacgatattctcgcccgtcttccaggccatatatcagcgcaacatcagcatatttggcgctggcttcgagaatgaagtcaccaaagaagcgttgatccagcgcgaccggcggcgactggctgaacagtttaccgagcgccggaagatcgcgttcccgaccaattacacacaacacatcgccttcgcgcagtcgggtgctgccggtaggatgaagcaactggttatcacgaaacagtgccgcaatacgcgtctcttttggcatatgcaaatcgcgcagtgccgcgcccacgcaccatttatcggcactcaattgataaacaaactgctcccacggattttccggatgaatatccaggccaacgcgtgacaccggacgtcccactggcggaaccaccactttggcttttttagccgcccacgagagtgatgttccctgcaagagcagtgaaaccagaaccacaaagaaggcgacattaaagaacagacgtgcattctccagccccgccatcatcgggaacacggccaggatgattggcaccgcgccgcgtaatcctacccagctgataaacacgcgctcacgcagattgaaaccgcggaaggggagcaatccagcaaataccgaaaggggacgggcgaagaatatcatccatgcggacaaaatgagcgccggaatggcaataggcagcagatcgcttgggttaaccaacagccccagcaccaggaacatggcgatttgcgccagccaggcgaggccgtcgaaattttgcaggatgccgtagcggttgcgaatagggcgattacccagcagaaaaccgcacagatacaccgccagaataccgctaccttccagcgcagtagttaatgagaaaatcagaataccgccacttaatgccagcaatggatataatccggcgggcagggcgatgcggttgatcatttgcagtagtaaataaccgccgccaagacctattacaatgcccagaccaaattgttgcagaatatcgacaatgaacatccagctaatattgctctcatgatgctggatcatcgcaattagggtaatcgtcagaaagaccgccattggatcattactgccggattcaatttccagcgtcgagccaacacgttcgttaagccccttaccacccagcagagaaaagaccgctgcagcatcggtagagccgacgatagcgccgattaataagccttcaatcaaatcaagattaaacagccacgccgccatcatgccggttaaaccagaggtgataagcacgcccagcgtcgccagcgacagtgccggtcctaacgccacacgaaaggaactggcctgagtgcgcatcccgccgtcgagcaaaataatcgccagtgccaggttacttaccatgtaggcgaaggggtaattatcaaacgggataccgccgacgccatcgactcctgccagcatgccgatcgccagaaaaataaccagaataggaatgccaagacgggaagaaaatgaactaagtaatatactgctggtgacaaggatggatcctaagatgaaaaggctaattattgttgtggcatccaacggtcggttactcctgattacgctgtctcttatataaaccctaccatattagcggcagagacagcgttttacttagccctgaagcgtgatttttttacattttaagaacaggatgaccgctaatcgtcaactgagtgccttcccgggtgttattcagaatggcatgtgcgcccaacggcagcgtaaccgtgcgttgttcatgaccaaaatcgaggccggtaatgagtggaatcgacaggcgggaacgcaaaaacgcgtacactgactccaggttgtaacctgcgtcataatcattgggcgtgctgccgctaaagctaccgagaataatcgccttctgacgtggcaaaattcccgcatgatagagctgcaacagcatacgttcgacccggaaagggtgctcgttaatatcttccagcaccagaataccgttctcaatttttggcatccacggtgtaccgatcagtgaaatcagcatcgcaagattgcctccccacaacgtgccttcggcccgacatgtcgggccttccccttgccattcaatggtgaaggtttcattgcgtaacgccagccagaaatggtgctcggtaaaggcgttcagttcatccgcgccaaagtttgctaccagcatggggccgctaaaggtgatgacattgccatgcgccagaagaccgcactgaatggcggtaaaatcgctatgtccgcaaatgagcaacgggtcatgttgttggcgagccaccagtgcctgccagtcaatatctgccagtaaacgactggcaccgtaaccgccgcgtacagccagcacgatggtgttgggggtagtcagtctggcaagggaattgagatcttccagacgctctgtttccgtacccgcaaaacgctcacaacgacgggcaataacctcgacgttattgacttgatgccccgcgtcggtaaggcgctggataccacgcagcgcggcgtgctgtttaatgcagtaacccgatggggcaattaagtgaaacagagacatggcaattccttgctgacaacagaaacgaaatgtatatcatgccgcttaggtgtgccgttgtcacctcaacggcgattccaggctataaggatagaagaagtgaaattgagatggtttgcctttttgattgtgttattagcgggttgttcatcaaagcatgactatacgaacccgccgtggaacgcgaaagttccggtgcaacgtgcgatgcagtggatgccaataagccagaaagccggtgcagcctggggcgtcgatccacaattgatcacggcgattatcgctatcgaatcgggtggtaatccgaacgcggtgagtaaatcgaatgccattggtttgatgcagttaaaagcttcaacctccggacgtgatgtttatcgccgtatgggctggagtggtgagccgacgaccagcgagctgaaaaatccagagcgtaatatttcaatgggggcggcttacctgaatattctggaaaccggcccgctggcaggcattgaagatccgaaggtactgcaatatgcgctggtggtgtcatacgctaacggggcaggtgcgctgctacggactttctcgtcagatcggaaaaaggcgatcagcaaaatcaacgatttggatgctgacgagttcctcgaacacgtagcgcgaaatcaccctgcgccgcaggctccgcgctatatctacaaacttgagcaggcactggacgcgatgtaaatcagtcgcgcactttgtccgctttttcccgggcttctcgctcgagagagaaaataatccgctgtaattgccgctccaccgtcgggctgacgttaagaaaacggaagctcagacggggagtggtgatggtttcattcttgccatcaatcactttgcgctcgctgatggagattaactgggcgtcaaagtgaaaaacaccccattgccccatgttgacttcaatctgagcgaagcgcatgccttcttgtaattcggcaggctttgctgtttccagtaatgcgcccatgccgcctaacgacaaatcatacaggcggaaacgtaacgtactgttatccgccagtttggtctggcaaaaataaggcggatggagtggggcggagatgcggaaatatcggcgtcgttgtacaaaccataaggtgggaggcggtacggtaataaatgccggaagctgcaagtattcactctgctgtagttgttcaacagtaaactcgactttcgcaccctgagtttcggcggtaatggtaatgtgctgtgcctttagcacggcgatgttgtcttcggcttgactgccgaaatccagcaccagtttatccggggttattgccagtaatttgctgatcagctgcccgccattccaactgagacgcaaaggaattgcggctttgtgcaaatcgcgtaacacgcccaggacggctaacggattttgtttcaggaactgctcatggtaatgactcacgcggaaaaactcctgactgacaaactgtctttggtttatcggtcacagttaacaaaacttaatacaaatgcgtgaatattttttacatgttgttcttaaatcagccgacatacgcccagcatcgatcccgcccttgcctatacttagagcgttgatgtaagcatttcttgcgtccgattcatcgaaacgagggcctgaacatgggaattattgcctggattatttttgacctgatagccggcattatcgccaagctaatcatgccggggcgtgatggtggtggatttttcctgacctgtattctcgggatagtcggtgcggtggtcggcggctggctggcgaccatgtttggcattggcggctccatcagtggttttaatctgcacagcttcctggtggcggtggtgggagctattctcgttctgggcatattccgcctcctgcgaagagaataagattttcataaggcggatagcgatacagatgccgctatccgctttcacatcagaacgtatactcgacacctgctttacgggtgaaaaaaatcaatatagcacttcgatatccgataaagtcggttcccggtaacaacaacagaatccttttttaattattgtttcgttgtttttggtgtgattcagaaaataaatattttagacagtagccagtcaggcgttaaaaatggggcggatagtgaggcggttttggctgcgcttattgaacatttagaattgatcaatccttctggcagattaagccaaaatacccgttcggcaatgcttcagttacgcgaagaggaatggtctgaattctttttttggttgctaaattctctggagtgtctggattatgtgattattaatttaactccagaaagcaaaaaaacgttgatgagtgaacaccgtaacaatattcaggtagcaattgatgctttatatagccaacgtcggcgtaaatcgccgggtgatgaaagtgaaacacttacccgtagaaatgacgctatcttcggcaaccacgtatggcaaacatttgcgcaatacttcccgccaggacttgaaaaaccgtctgtgtagaaaaaaccatagctatggtgttatctgccgacaacgccatccggagaagccgaatgacgttgtcggagtaagcgctggttaaggtgtgggttgtgcctctttggttgagggttgcgtcgttgctgacttaacggtcggacgcgtcgccggaacattgtcacacggttgctctttcgggcagatcaaatccagcattttcagcgtcacgccattggtccagccaaagccatcctgtaatggatattcgccaccgccgccccccgttccggtggtgctgacatcatatttttccaccagctttttctcccggtcataggtgtgctgaacattggtcaggaagtgccagctaatgtccatcgccacctctttttgcccgtagttttgtaatccttctgtcgcgacccactgtaacggtgcccagccatttggcgcatcccattgttgcccacttttcaccgacgtggtgttcaggccgccgggttgcagcagatgtgttttcgtcgccgtcgccattttgttggcgcgatctttcgctgccgcattgacgtacagcgggaacagggcggccgcggttaactgattgcgcactttatgacttttcaggtcgtaatcggcataccagccttgttgatcgttccacaggtatttttcgatccctttttgacgggcatttgccagcgtttcgtactggtttgccatcgcgttatctccggcagctttgctggcgcgggcgaggattttttccattttaaacatcaggctgttcagatcgaccggtacgatgctggtggtgcgtaaggtatttaactgctgcgggttgtccatccagcgcgagctgaaatcccagccagacgcagcggcagagcgcaggtcgcggtaaatttcagtggcaggtcgattcggattgcttttggcggtggcaatatcttccacccatgactctggtcgtggcgtatcgcgatcgtcccagtagcggttgagaagggtaccatcctgaagtttgacaacgcgtttttcctgttgtccggcttgcaggttttcaacaccgtccatccagtaagcatattctttttgcatttgcggcaggtattgcttcaacgcggcatcgccttcatgctgcgccagtaactctaccatcagggcaaagaagggcggttgcgagcggcttaaatagtaactgcggttgccgttgggaatatgaccgtaagtgtctatttcatgagcaaaattggccaccatatccgcgactttatcccagtgaccgctttcggcaagtcctaacatggtgaagtaactgtcccagtaatatacctcgcgaaagcgtccgcccggcacgacataaggttccggcagcggtaacagagaatcccatttttcggtgttttcggtagaacgcgttaataccggccaaagtccgtcaatatgttcgcgcagtgactgcccctctggcggaacatatttctcgccttctttcggcagggtgaaattgacgttaacgaaatggcgcagatcaaatccgctctggttttgctgcatccgataatcagcaaggatcatcagcggatcgctgttcggcacggcatcggcaaaggttttttggtccggaaaaagtttggcgttttgcacatcattaaacagcggccctaataaaatatcaggcggctgtggtgttaccggtgtttcttctgcctgcaccgatagcgcagcgaaacacaaaaagatacaggctggaattaacgccattttttgcgggcgagaaggtgcgggggatttcatcaatcattctcctttggcgaaaccgaataaaacggtattcaagtatcagaaaaccttagttcaggatcgcactagctgcatgatcgaaatctcattctgcgaactgtcaggcattttagaaaagggaattaaagggataaataacggcgaaatagagtgatcaaataacgtctgtttattagccagccagcggcgttgggttcgtgattagcgaagaaaaatcatcataaattggtgaaaaatataacaggtagttaaaaaccattagtgctgagtaaattgccggatgacatcagaacgatgccatccgaacagtggcttaaccctgacggttgaaacgttgcgttttaacgtccagcgttagcgtttcttctggttgtatcgcatacagtttctcaccctgctggcaaatccagccaatccccagttcacgggcgattagggcgctgtgggataccggacttccggcgctaaggcagataccttttacaaccgccggatccagttgcagtactgtggaaggataaatgttctccgccagtagaatagttggcgagttaaactgcgggagttcttctttcgtttgggtcaggtggaccagggtgcgatgcagaagatcgtccacatcaatatagcgagcttgtagatattcatcatccagttgctggtattgctggctaagttctttaagaacttgctgccaggcatattctgccgtgcaatgttcatgctgaaggagttcgcttgccgccgccagcagttccggatcatctaacagtgtatggtgaccagaaaagattgcggcaatatcgtcaagcccgctggcttctgctttcgctgttaacgtcatcagatctaataacgtgaagtcaatagcctggcgtaatcgatcttgttcttcttccacggtcagggttgattttgcctgtaccgtacataaaactggttgataataaaaggctttacccgaaacaggcggaacgggacgcagagtaggtggagcgacttcctccgtttcaccaaagttatcttcagccagctgacggaaagcgatcagtgcctcttcagcttctggccctttcgcaatcaggcgcagcgtatcgttatagcgaacttgtagtaacgcaatctggttaatactctctggtgtgacgcatttgccgtttttttccagcaacatatcggcattaaatgtcgataaggtataaaccagccgggaggccggacgtacatgcaggccgttacggttttttatgaccaccgccagagaacgggcttcttcatcgtacgcaggacatgtgtcagagatttcagtgtcggaggacggtaaacccagttgttcacgtttggcttccagcgcatgcatggcgtcaaagataactttgtcgatatccgcccccgaggccgcgctgaccgttgctgccagtgtaccttcgaccaacggcgcagcacacaaacgtacttttgcggcgatctcgggagccagcaattccagcgcagtttcagcactcaataatgcgctacccatatccatcatgaccagcacatggtcggcatcagcaacagattcgatggcctccatcactttgacggcatcggtaccaatgggattttgtggatcgtcaattcccgcggcaatggcgattttacaactatcactcattaacatctgacgggctaattcaccgacaccttctcccagtcggctgctatgtgaaactatgaccaggtttaccatcaccaattccttactcttttgcggctaacgccaacatttgcatcataaacatcaccgaggtcgcgccgggatcctggtgaccaatactgcgttcaccgagataactggcgcggcctttgcgggcttgcatcgtaatcgtactttgtgcagcggattcggcgatgctactggcagcttcgagcgccaccggaacagagagattttgctcgctggactgacgtaacgattccaccaccggcacccacacatcacacatggttttatcgccaggttcggctttcccgcgactgattacgccgtccgcgccatcgcggaacatctgataaagctcttccagtgtcaggctttgccgtgcctgggtcgcctgtgcggcgcggataaagaaggtaccgaacagcggaccactggcaccaccgacgctggaaagcagcgtcataccggtattcttgagaatgaaaccgatatctttatctgcgatagcagggagtttttccaccactttgctaaagcctcggttcatatttagcccgtggtcagcatcgccaatttcgcgatccagtccggtaagatactcgctctcggtgctgaaaatatcgccacaacgagtgagccagttaacaatttgagttctgctcagtgacattgctttctccttatttaccccagttaagggccggggtgtggaccggggcgtcccagagtgccagcgtttcgtcatcaactttcagtaaggtgattgagaaaccggtcatatccagtgaggtgcagtacgcgccaattaaattacgttcgatagtcaatcccgcttgctggcaacgtgtggtcaggcggttatagacgccgtacagctcagaaagcggagttgcgccaagattgttaaccagcgcaatcacccgatcgccagactggagcggttgtttggtttgttgttcttcctgccaactgccttgttgataatcccagaaacgcaaagtgcgatggtatgagccatttaccagcagggtgtcgaacatttcatcgacggtttgatcaagggaagagaaggggcggcggtcaatacccggctcaccatgaatgccgacgccaaactccatctcattatccgccagggtaaaagaaggtttgcccgcggcaggaacggtacaggcaccgagagcgatacctattgagtggccttgattattcagcttacgccccagttccgcacaggcgtccagtgagtcgccacgctccgccgctgcgcctacgagtttttcaattaatacggtgttggcaacgccgcgtcgcccggcagtataaagactgtcttttaccgcaacgtcgtcatcaatgaccacagtggtcacttttacgccgctatcgtgcagtaactcggtcgctgtttcaaagttaagaatatcgccggtgtaatttttgataatcaacagtacaccttcgccgccatcaacttgcatggcgcattcaaagattttatcgggcgtcggtgaggtgaaaatttcgcccggacaggcccccgaaagcatcccctgaccgatataaccacagtgcatcggctcgtgtccgctgccgccacccgacagcagggcgacttttcctgcaacaggggcatcagctcgggtgacatacaccggatcctgatgcagtgtcagcgatggatgcgctttcgccagtcctgccagttgttcgtccagtacgtcttgcacatcattgatcaattttttcattattttgctccagcaattacggtagggcatggatgatgttcaacgacacggcgaccactgactgccgatgaatccattgtgcatcaggcaagggaaaagaaaattagcccaaattatgtttcatagtgaaacatatgctttaatgaatgttccatattgaaacttttacgtgtattaatacttaaaattgcgagccggaacaccttttgtcataagggatgcgggatatgagtggcgcttttaacaacgatggtcggggcatatctcccttaattgcaacctcctgggagcgatgcaataagctgatgaaacgggagacatggaacgtaccacatcaggcccagggcgtgacatttgcttctatttatcggcgtaagaaagcgatgctgacgctcgggcaggctgcgctggaagatgcctgggaatatatggcaccgcgagagtgtgcgctgtttatcctcgatgaaaccgcctgcattctcagccgtaatggcgatccgcaaaccttgcagcagctaagtgcactgggattcaatgacggcacgtattgcgccgagggaattattggtacttgtgcgctatcgttagcggctatctctggtcaggccgtgaaaacgatggccgatcaacatttcaaacaggtactctggaactgggccttttgtgcaacgccgttgtttgacagcaagggccgattgacgggaacaatagcgctggcgtgtccggttgagcaaactaccgcagctgatttgccgttgacgttggcaatcgcccgcgaggtcggaaatttactgctgacggacagtttgctcgctgaaactaaccgtcatttaaatcaacttaatgccctgttagaaagtatggatgatggcgtgattagctgggacgagcagggtaatttgcaatttattaatgcccaggcggcgcgggtcttgcgccttgacgcgacggcaagtcagggacgggcaatcactgaactcttaacgttacccgccgtattgcaacaagcaataaaacaggcacatccgctcaaacacgtagaagcaacctttgaaagccagcaccagtttattgatgcggtgataacccttaaaccgataatagaaacgcagggaaccagctttattttgttgctccatcctgtggaacagatgcggcagttgatgaccagtcaattaggaaaagtcagccataccttcgctcatatgccacaggacgatccgcaaacccgccgcttgattcattttggtcgccaggcggcgcgcagtagctttcctgtcctgctttgtggagaagagggcgtgggcaaggcactgctaagtcaggcaattcataatgaaagcgagcgtgctgcaggtccttatatcgccgtcaattgtgagttatatggtgatgctgcgctggcggaagaatttattggtggcgatcgcacggacaatgaaaatggccgtctgagtcggctggaactggcacacggcggcacgctgtttcttgaaaagattgaatatctggcggtggagttacagtctgctttgcttcaggttatcaagcagggggttatcacgcgactggatgcgcggcgtttaataccaattgatgtcaaagtgattgcaacaacgaccgcggacctcgcaatgctggtggaacaaaatcgttttagtcgccagctgtattacgcgctgcatgcatttgaaattaccatcccgcctctgcgtatgcggcgtggcagcattccggcgctggtgaataacaaattacgcagtcttgaaaaacgcttctctacgcggctgaaaattgatgacgatgccctcgctcgcctggtttcttgtgcatggccaggcaacgattttgaactttacagcgtcatcgagaatcttgctctgagtagtgataacgggcgcattcgcgtcagtgatttgccggaacatctgtttaccgagcaggcgacagatgatgtcagcgccacccgcctttccaccagtctgtcatttgcggaagttgaaaaagaggcaattattaacgcagcccaggtcacaggcggtcgcattcaggaaatgtcggctttacttgggatcggccgcactacgctgtggcggaaaatgaagcaacatggcattgatgcagggcagtttaagcgccgggtatgaaagacagaaacgatttctgatacatcagagtgatctgtatttcattccggcgcacgctaacaattttcagcatcgtttaagggcttgtctatcccgcacttaaaagctgaagcgatatcctccgttgacttgcttctgatcaaagaggttaccctgcgtgtaatccgcttcgagatagaatgtgtgctgtttgttatactgtgcactgactcccacgccgttattccagccattacctttgaaactgtacttctcccgggagttgttcaacagatattcggtatcccctgaaaactcgcggatagcgccagtcttcacatagacattcagctggctgttgcctgcggtgatgtcataccccagtatcatgctggcacgccccagcagcgattcgtagtgattcagatgtatattgaggccattactcgccttcatagtcatctcattctggtggctgtatgtaagctgggtttgcggctctatatagaacccataaccagtaggggacaggttgaacctctgcccggcttccagggagatgctcattccattcgcagtgccgttggcgttaacgccgttgttctgactgtccagtacgtggaaactatttttctggcgcgatgcttttataacgagatcgctgtaaaaaccgttttgtgccatgtaactggcgtacattcccatgtagtctgaacgtgcggtaccgtcgcctccgctatagtccggcgatgcatgtgttgagccaatatacagaccgacatacaacggcattacatcagagagacgtttatccccaccaaactggataccgctgtaacccatgtcaaagccgctcagtttgccactggcaaaggagtccaggcttcccccataactgcgcaaccagatattaccgtctttactctgatttcgcaggtcacccatccgttgcatcagcgtacggttttcaacatagttcaataagtaaccgacattgagataattgccgccagcatctgcggtcgtggtgggtttaggcgtgggagcgggttcaggcgtaggatcggggttgactatgggaggctgagcgggagctggtgtgggttcaggattaggagtcggttccggaactgtcccggaagcgtaaagctcccagttagtgccatttttacgcacatcgtacagatatccccccaactcaacctgagaagacgcgctgaacgaggccgcgccgtcagtggtttttaccactgtcagaacttcatttcccgttgtggcctcgctgccctggttgcggatagccaatacgtgattaccagcactactcccgctgatattcaataaatcccctttattattaacgccattaccctcgccaacaacatcagcacgcataataaaggtactgttaccgctcaggttctctacgtttaatgtggcaaatgtgccggcagttgacccgtggctggcaaaatcgacagttgaatggctcagcgccagcgtgtcgagattagaattacttgttacgttccagacgctgttattcattgcaacgtccagttttccgccattgacattatcgctgagggaggaacctgtccaaaccgacccagggtgcatatccagattgattagcccacctttggaaagaacgctaccgttgataagcatacgacccgaggcgttgatgcggctggcggcataaccatcgtcatgttgcgttgcgatggccatctggtcgggtgtactcatatcaatgaccagatcgctcgtgaggtcgatctggctgttggtcatggcataaattcccctggctcctgccgcgccggtgatagccaaactgtctccggttattctaccgccgctgagagcccacaaacccagcgccagactgccattacgatcaactgtaatatcggtattttgcatgttgacaacagccgttgccgtctgggccgaggcaccataagaaccgccggaaaagatgctgtttcgttgcgctgccgtgccagtaaaattgattatcgcgtctgaaccactggtgacgaggccaccgccctgcgcggaagaaatatggctatctgcaccgatagtggttgtaccaccacgaacttcgacgccattggccgcggctccagttacatcaacagtgagtgcattcgcgctaacctggccaaagctccagaggccgtgagcattatcgccattggttttaatggtactgtttgttccgagatcgacaacagagtttttctgtacgtttatccccatggcgctgtagccctgaacatcgattgtcaggtctgtagccgtaaaacgcgcagcaccattggcgttattgccgttgagaccaccgatataaacacctgtacttccatcggtcgtgattttacttccgcttccaagatcgacactggtgccatagtcattgatggttaggcctataccgttcgagttttcaatggtgaattgagtggctgttagtgttgagctatgcccaataatgatgccgtcatcgttactcttaatggtgctgcctgtgcctaagtcagcatgggtatagtcaccaattaagttaatgccgatggcagaggtttgaccaacaacatctactgtgagtcggttagctgtcagggagctgtttttgccctgaataatgattccttttgcatatccagaggcgtcgttgacattgacggtgacatcattacccaggttgatattgccaggcgtgtttcctgctggggtcattacaccatagaggtttcctgatggatcggcggtatctcctgtaattctgtcaccatcattaatagtaatattggtgccatattgacttcctgtatcagcagctatcagcaggggggaaaagataattgcattcaaaccaatagcgccaaattttatcagttgaattgagggcgaacggatttttaattcagcgagacgatctgctttggtattcccattgtgttgtttgatgcccataccactcctatatagtacccagactatgggtctatggattttgtcattttgtttaaatcaatgaataatatcctcttatcatcatgatatttgtatggtgcaatcatgatgagcttctcagagaataattctctattaccgggcaaaatcaggaacacaggaattaatatatatttaacatcccccttacaaaggtgagtttatatcgagttattccctaagttgtcgttacttattccaattcgttactataaatatggcaaaaatattacaacaaacagcggttaaaaaatttggtgaagattttttgtaataatcctaattagttatgggaatttcgcttgatgtatctgcataacaaaaacaatatgcgccatttttgcattactaataagaaaaagcaaaaaacatcgatattcatttttggtcaatgggttttctggcctatcgttgttattgtgctactggttatcattttcatcttgccagcatattggagcgtgatcaattttgatcagctgtgaagggggctgatgtgtagtgatacaaaaacttacgttatatcactgctaatgagatatccggcatctgaacacttatgtctttaattattctcgtggttcactataggcaataagcacaaaagtgtaggatgttacaagaatgattaggactcggtgaaatgaaaaatccacgcaattgcgtggattttatatacttttgcgctcttcatgagatttagcgaaacctcatgagacaataaattaattagacgttgaaaaggaagttcatcacatcgccatctttcacgatgtaatctttaccttctgcacgcattttgcctgcttctttcgcgccttgttcacctttgtaagtgatgaaatcttcaaacgagatggtttgtgcacggataaagcctttttcaaaatcagtatggattttgcccgctgcctgcggcgcggttgctccaaccggaatggtccatgcacgcacttctttcaccccagcggtgaagtaagtttgcaggttcagcagtttataaccggcacggatcacacggttcaggcccggctcttccagcccaagctcctgcataaactcgtcacgttcttcgtcgtccagttcggcaatgtctgcttcaacagcagcacaaaccggaaccacaacagaaccttctttcgccgcgatttcacgcacctggtcaagatatgggttgttttcaaaaccgtcttcgttgacgttggcgatgtacattgttggtttcagcgtcaggaagctcaggtaacgaatagccgctttctcttcagcgcttaaatccagcgcgcgcagcatacctgcattttccaactggggcaggcatttttccaggaccgccagctcagctttcgcgtctttatcgccacctttggctttcttctgtacgcgatgaatcgcacgttcgcaggtgtcgaggtctgccagcgccagttcggtgttgataacttcaatatcgtcagccgggttaactttgccggaaacgtgaatgatgttgtcattttcaaagcagcgaacaacgtgaccgatcgcttcggtttcacggatgttggtcaggaactggttacccagaccttcgcctttcgatgcgccttttaccagaccggcgatatcgacaaattccatggtcgtgggaagcgtacgctgcggttttacgatttcagccagttgatccaggcgaggatcaggcattggtacgacgcctgtgttcggctcaatggtgcagaatggaaagttggccgcttcaataccggctttggtcagcgcgttgaacagggtagatttcccgacgttgggcaaaccgacgataccgcatttgaatcccatgatttaaatcaccttaatatcttaataatcaacctgttattgctaacagattgcagaaatggaaataactttgcctattatacacggcactcggcaaaaatgccgcagacaacgacttattgcgctttaaaggcgtgcaatcggttcgttgctttggtcaagccatctgtaaaccacatttcagtacaacgcgccgcttcgtcaatggcttcatcaattaacttctgttcactaacaggcggtttgcctaacacaaaaccgacaactttatttttatcgcccggatgaccgattccgatgcgtaaacggtgaaagttagggttattacccaatttactgatgatgtctttcagtccattgtgaccaccatggccaccgcccaatttaaatttggcgacgccaggaggcagatccagttcgtcgtgggccaccagaatttcgtccggattaatgcggaaaaaactggccatcgccgcaacggctttgccgctgagattcataaatgtagtcgggactaacaggcggacatcttcgcctccaagagtgactcgcgaagtataaccaaagaatttagcctcttcgcgcagcggagcgcgcaaacgctctgccagtaagtcaacgaaccaggcaccagcattatgtcgcgttgcggcgtattcagcaccggggttcgccaggccgacaatcaatttaatcgtcacgtttttttgtcctgagtgtgtacataactggcgcgtagtttactggttgcggccccgcttgacaaaaaactgcgtatcaaatgcagataacgtaataattgcctgagtggactattagaaagtcaaggtgttcaggcgtttatttgtaaagttttgttgaaataagggttgtaattgtgatcacgcccgcacataacccactgggtgttgtctatactttacacataaggaagaggggtattccctgttacaacccagaaagttccggaggtgacatatgaaacgcaaaaacgcttcgttactcggtaacgtgctcatggggttgggtctggtggtaatggtggtcggcgtggggtattcaatcctcaaccagttaccacagtttaatatgccccagtatttcgcacatggtgcagtgctaagtattttcgtcggtgccattctctggctggcgggtgcccgtgttggcgggcatgaacaggtgtgcgaccgttactggtgggttcgccactatgacaaacgttgccgccgtagcgataatcgccgtcatagctaacaaataatgcagtttgctgaccagtcagtttgcgctgactggtcaatctcgtacttataaatccgccatcgccgcgcgacgattcgggaagaacgccaggcgtcccgggatcggttgaatgccagcgcgagccatagtgcgcagtggctggaattccacgttgcacacgcgcagttcacatccctcgggcagacgcttcacaaaacgctggaacgcatcaagaccaccagcatcaagtaccggaacggcatcccacttcagaatcacaatccgtttgccttcaagacgtgactccaggtccgtgaataagccttcagcagcagcaaaaaacagcgggccaataacgcgcagaaccaggacatcgtctggaacatctacgactaccggtgccaggcgagtcatacgtgcgatacgacgcataaacagcagcgatgccagcacgatccccacgctgatggcaataaccatatcaaacaacacggtcagcgacatgcacagcagcatgacgatgatgtcatctttcggcgcatgacgcagcaagtcgaccactttgtgcgcttcactcatgttccacgccaccatcaacagcagggctgccatggcggaaagcggcagccaggagagcagcggtgccagtaccagcagggcaagaataaccagaatagagtggatcaccgccgagataggggacgttgccccggcacggacgttagcggcagaacgcgcgatggcagctgtagcggtaataccaccaaagaacggagcgataatattccccagtccctgtccaaccagttcgctgttcgccttgtgtttcgtcccggtcataccatccagcaccacggcgcagagcagagattcgattgcgccgagcattgccattgagaatgccgcaggcagcagtgtgcgaatagaatcccaggttagcgtgaattctgaattaggcagatcccacggcagcaccagttgcggcagcagttgcggaataccgttaccctgagaaccatcggccaggacgtagtggaattgcgaaccgatggtagcaacatgtccgccgagcaggttaacaatccccatcaccgcgcaaccagccagcaaggccggaaggtgaccgggtaaacgaatgcccagacgcggccaaaaaacaagaatacctagcgtcacaatgccaatggcagcatcacccacattaatggtcggcagcgccataaataatgcgccgactttttgtagataatgttccgggacatgggccatttgcagaccgagaaaatctttaatctgcatggtaccgatggtgatcccgatacccgaggtgaaacctaaggtgacggaaaccggaatatactcaatcaggcgaccaaagcgtgccagacccatcagaatcaaaaagatccccgacagcaaggtcgcaaccagcagtcctgccagtccaaactgttgcgacacgggatagagaattaccacaaatgccgcagtcggaccggaaacgctaaagcgtgacccacccgtcagagcaatgacaatccccgcaacagctgcggtatataaaccgtactggggtgccacaccactaccaatagccaacgccatcgccagcgggatagcaataatcccgacggttatcccggcaatcaggtcacgggtaaaccgtgcggcagtatatttttctttccagcaagcgtcgatcagagcgcggaaaggcatcacatgtgaggaaaatattttgttcacaataatgtttcatccgtgagcgcatcatctgtcaactaaatggcaggtgaaggaggcataggtcatacaaatggatattacagacaaaaaaacccgccgcagcgggtctttgagccgggttcgattagtgttcgaacatggcagagatcgattcttcgttgctgatacgacgaatcgcttcggccagcatacctgacagggtcagagtacgcacgttcggcagtgatttgatttcatcgctcagcggaatggtatcgcagacaacgacttcatcaattacagagttacgcaggttgttcgccgcgttgccagagaagatcgggtgagtcgcgtacgcaaatacacgtttagcaccacgttctttcagagcttcagcagctttacacagcgtaccgccagtgtcgatcatatcatcgaccagtacgcagtcacgacctgcaacgtcaccgatgatatgcatcacctgtgaaacgttcgcacgcggacgacgtttgtcgatgattgccatatcggtatcgttcagcagcttagcgatagcgcgggcacgcacaacgccgccgatgtccggagaaaccacaattgggttatccagattcagctgcagcatgtcttccagcaggatcgggctaccaaatacgttatcaaccggaacgtcgaagaaaccctgaatctgttcagcgtgcagatccactgtcagcacacggtcaacaccgacgctggagaggaagtctgcaaccactttcgcagtgattggtacacgagcggaacggacgcgacggtcctggcgcgcatagccaaagtaggggataacagcggtgatacgacctgcggaagcacgacgcagggcatcaaccataacgactaattccatcaggttgtcgttagtaggggcacaagtggactggatgatgaaaatatcaccaccgcgtacattttcattaatttgtacgctgacttcgccatcgctaaagcgacctacagcggcgtcgccgagtgaagtgtacaggcggttggcaatacgttgtgctagttccggggtggcgttaccagcaaaaagcttcatatcaggcacgagaagaacctcaggcatgcgtccattggtggaaagaatctgccgaaaactgtgcgggccaggcatgatcctttccaggcggtgtattaaagagcgcgatgcaacgtctggaacaaggtgacgttgtcaccgaaactcagcttgcccggcttaaagcatggctctgtgcaatggggaaagattagcgcctttcgccacaaagccattgagccattccggggcttgctctagcacctggcgggcttcagactctgtatcaaattcagcaaagacacaggcccctgtcccagtcaggcgcgacggggcgtattctaacagccaggaaagcaccgcatcaacctcgcgaaaacgttttcttgcgataacctcgcaatcattgctgaattcacattttagcaacgtttctattgacctttttggcgtattgcgcgggagttcaggatctttaaaaatcaccggagtcggaatacttacaccagggtgcgccaccagataccacttctctggcggatccaccggcgttagtatttcaccaacgccttcggcaaacgcggcatgcccccgaacaaagacaggaacatctgcgcccagcgtcagccccatttccgccagctcatccatgcttagcccgcattgccagagatgatttaatgccaccaggaccgtcgcggcattggatgaaccaccgccgagaccgccgcccatcggcaaacgcttgtcaatgctgatattcgcaccgcttcccgtcggaagacgcccgctgtctgccgcagttttcatcaacaatcgcgctgcgcgaacgatcaggttatcttcatgttccacgccttcaacgggcgttaacagacgaatatccccatcgtcacgaagctcaatgctgatggtgtcgccgtaatcaagaaactgaaacagcgtttgcagcgtgtggtaaccatccgcacgctgaccggtaatgtataaaaacagattaagttttgccggagagggccactgtgtccgcattatttcactatccagttatccatttttaacttgatgcgttgaccaccgtcggtgagttccatattggctggcatcgcaggttgcgttttggtgtcataaccaccataaacaaccttccagtttttgccattctggctgtaggtaatttcgctcaggcggtactggtcgtccagtttgtagtcggttgcatcacccggtaaacctaaaatccactggcgcaagctgttgagcggaattggcattccggtcaatttgccaatcatctcttcggcgtcatcggcggtataacgctgacctttattgtcgactaactgcacgttacccggttgagcattcagctccagttccgtgctgcccaatgggttagtgagcagcagacggtagcgatcctggccggtttgctgccagaaaaagcgggcgtacactttttgttggtcagaaatataagcgaacgcgccgcgagtctgatactgattaagattgcgcacgtcttgctgatgctgacgccattgtggcgaatccgggcttttgccaggacctttgggcgtggtaacggaacaggcagtgagcacaagagcagccagcggtagcaggcggataagacgaaaatcgggcaggggcatagtgatgacaagtccttgagatacgttgcagttataacccttaatgctagcgttaccgtccgctatcgtctatgttcaagttgtcttaattgccagaatctaacggctttcggcaattactccaaaagggggcgctctcttttattgatcttacgcatcctgtatgatgcaagcagactaaccctatcaacgttggtattatttcccgcagacatgacccttttagcactcggtatcaaccataaaacggcacctgtatcgctgcgagaacgtgtatcgttttcgccggataagctcgatcaggcgcttgacagcctgcttgcgcagccgatggtgcagggcggcgtggtgctgtcgacgtgcaaccgcacggaactttatcttagcgttgaagagcaggacaacctgcaagaggcgttaatccgctggctttgcgattatcacaatcttaatgaagaagatctgcgtaaaagcctctactggcatcaggataacgacgcggttagccatttaatgcgtgttgccagcggcctggattcactggttctgggggagccgcagatcctcggtcaggttaaaaaagcgtttgccgattcgcaaaaaggtcatatgaaggccagcgaactggaacgcatgttccagaaatctttctctgtcgcgaaacgcgttcgcactgaaacagatatcggtgccagcgctgtgtctgtcgcttttgcggcttgtacgctggcgcggcagatctttgaatcgctctctacggtcacagtgttgctggtaggcgcgggcgaaactatcgagctggtggcgcgtcatctgcgcgaacacaaagtacagaagatgattatcgccaaccgcactcgcgaacgtgcccaaattctggcagatgaagtcggcgcggaagtgattgccctgagtgatatcgacgaacgtctgcgcgaagccgatatcatcatcagttccaccgccagcccgttaccgattatcgggaaaggcatggtggagcgcgcattaaaaagccgtcgcaaccaaccaatgctgttggtggatattgccgttccgcgcgatgttgagccggaagttggcaaactggcgaatgcttatctttatagcgttgatgatctgcaaagcatcatttcgcacaacctggcgcagcgtaaagccgcagcggttgaggcggaaactattgtcgctcaggaaaccagcgaatttatggcgtggctgcgagcacaaagcgccagcgaaaccattcgcgagtatcgcagccaggcagagcaagttcgcgatgagttaaccgccaaagcgttagcggcccttgagcagggcggcgacgcgcaagccattatgcaggatctggcatggaaactgactaaccgcttgatccatgcgccaacgaaatcacttcaacaggccgcccgtgacggggataacgaacgcctgaatattctgcgcgacagcctcgggctggagtagcagtacatcattttctttttttacagggtgcatttacgcctatgaagccttctatcgttgccaaactggaagccctgcatgaacgccatgaagaagttcaggcgttgctgggtgacgcgcaaactatcgccgaccaggaacgttttcgcgcattatcacgcgaatatgcgcagttaagtgatgtttcgcgctgttttaccgactggcaacaggttcaggaagatatcgaaaccgcacagatgatgctcgatgatcctgaaatgcgtgagatggcgcaggatgaactgcgcgaagctaaagaaaaaagcgagcaactggaacagcaattacaggttctgttactgccaaaagatcctgatgacgaacgtaacgccttcctcgaagtccgagccggaaccggcggcgacgaagcggcgctgttcgcgggcgatctgttccgtatgtacagccgttatgccgaagcccgccgctggcgggtagaaatcatgagcgccagcgagggtgaacatggtggttataaagagatcatcgccaaaattagcggtgatggtgtgtatggtcgtctgaaatttgaatccggcggtcatcgcgtgcaacgtgttcctgctacggaatcgcagggtcgtattcatacttctgcttgtaccgttgcggtaatgccagaactgcctgacgcagaactgccggacatcaacccagcagatttacgcattgatactttccgctcgtcaggggcgggtggtcagcacgttaacaccaccgattcggcaattcgtattactcacttgccgaccgggattgttgttgaatgtcaggacgaacgttcacaacataaaaacaaagctaaagcactttctgttctcggtgctcgcatccacgctgctgaaatggcaaaacgccaacaggccgaagcgtctacccgtcgtaacctgctggggagtggcgatcgcagcgaccgtaaccgtacttacaacttcccgcaggggcgcgttaccgatcaccgcatcaacctgacgctctaccgcctggatgaagtgatggaaggtaagctggatatgctgattgaaccgattatccaggaacatcaggccgaccaactggcggcgttgtccgagcaggaataatggaatatcaacactggttacgtgaagcaataagccaacttcaggcgagcgaaagcccgcggcgtgatgctgaaatcctgctggagcatgttaccggcagagggcgtacttttattctcgcctttggtgaaacgcagctgactgacgaacaatgtcagcaacttgatgcgctactgacacgtcgtcgcgatggtgaacccattgctcatttaaccggggtgcgagaattctggtcgttgccgttatttgtttcgccagcgaccttaattccgcgcccggatacggagtgtctggtggagcaggcactggcgcggttgcctgaacaaccttgccgtattctcgatctcgggacgggtaccggggcgattgcgcttgcgctggctagcgagcgcccggactgcgaaattatcgctgtagatcgtatgcctgatgctgtctccctggcacaacgtaatgcccagcatctggcgatcaaaaatatccacattctgcaaagcgactggtttagcgcgctagccgggcagcagtttgcgatgattgtcagcaatccgccgtatattgacgagcaggaccctcatcttcaacaaggcgatgtccgctttgagccgctcactgcgctggttgcggcagacagtggaatggcagacatcgtgcatatcatcgaacagtcgcgtaacgcgctggtatccggcggctttctgcttctggaacatggctggcagcagggcgaagcggtgcgacaagcatttatcctcgcggggtatcatgacgtcgaaacctgccgtgactatggtgataacgagcgcgtaacgctcggccgctattatcaatgacaagtttttctacactgcttagtgttcatcttattagtatcgcgctttctgttgggctattaaccttacgtttctggctacgttatcagaagcatccacaggcatttgctcgctggacgcgcattgtgccgccggttgtcgatacgctgttactgttaagcggcattgcgttgatggctaaagcgcacatcctgccattttccgggcaggcacagtggctgactgaaaagctgtttggagttatcatttatatcgttttgggttttattgcactcgattatcgtcgtatgcacagtcagcaggcgcgcattattgccttcccgctggcgttggtggtgctgtacatcatcattaaactcgccaccacaaaagtaccgttactggggtaagtcatgagatcgttagctgatttcgaatttaataaagcgccattgtgcgaaggcatgatcctggcttgcgaagcaatccgccgcgattttccctcgcaagatgtttacgacgaactggagcgtctcgttagtctggcgaaggaagaaatcagccagcttctgcctttagaagagcagttggaaaaactgatcgcgctgttttacggcgactggggatttaaagcctcacgcggtgtttatcgtctttccgatgcattatggctggaccaggtgttaaagaatcgacagggcagtgcggtatcattaggtgcggttttattatgggtcgcgaatcgtctcgatttgccgctgctgccggtgattttccctacgcagctgatattgcgcattgaatgtccggatggcgaaatttggctgattaatccttttaacggtgaatcgttaagcgaacatatgctggacgtatggttaaagggaaatatcagcccgtcggcggaactgttttatgaagaccttgatgaagctgataacattgaggtaatccgcaaattgctggatacactcaaagcctcgttgatggaagaaaatcagatggagctggcgttacgcaccagcgaagctttattacaattcaaccctgaagatccctatgaaattcgcgatcgcgggttgatttatgcgcaactggattgcgaacacgttgcgttgaacgatttaagttatttcgttgaacagtgtccggaagacccgatcagcgaaatgatccgtgcgcaaataaataacatcgcgcataaacatattgtgctgcattaattaatcgacattttactcaagattaaggcgatcctatgaaacaaaaagtggttagcattggcgacatcaacgtagcaaatgacctgccgttcgtactgtttggcggtatgaacgtgttggaatctcgcgatctggcgatgcgcatttgcgagcactacgtaactgtgacccagaaactgggtatcccttacgtgttcaaagcctcttttgacaaagccaaccgctcctccatccactcttatcgtggaccgggcctggaagaagggatgaaaatcttccaggagttgaagcagacttttggcgtgaaaattatcaccgacgttcacgaaccaagtcaggcacagcccgttgctgatgtcgtggatgtgattcagttgccggcgtttcttgctcgccagactgacctggttgaagccatggcgaaaaccggtgcggtaattaacgtcaagaaaccacagtttgtcagcccgggacagatgggtaatatcgttgataaattcaaagaaggcggcaacgaaaaagtgattctttgcgatcgcggtgctaacttcggctatgacaacctggttgtcgatatgctgggcttcagcattatgaagaaagtgtctggtaactcgccggtgattttcgacgtgacccacgcactgcaatgccgcgatccgtttggcgcagcttccggtggtcgtcgtgctcaggtggctgagctggcacgagccggtatggcggtaggtctggcggggctgtttattgaagcgcatccggatccggaacatgcgaaatgtgatggtccatccgcgctgccgctggctaaactggaaccgttcctcaagcagatgaaagcgattgatgatctggtgaaaggtttcgaagaactggataccagcaagtaatcttttttgcttgaaaaataaagtattagcgttctgcgttaagacttttttcatgggtgccggatacaaaaaaggccgcaggctgttacccctgcggccggtttcgggcgcatattgccatcacggcagcctgacgcccgttttcaccttacttccggttacgccaccagctgacaatcgctgcggtaataattcccgccaggatcggtgctgccaggtcgtgccagaaaatcatggcaaactgcgcgagcgtcatatagccgccttgttgtaatgacaacattttgcggctattcttgaattgttctggttcaagattagcccccgttctgttgtcaggttgtacctctcaacgtgcgggggttttctctttccagcaaccaatgccaccagggataaagcccccgcaacattgcgcctcaccggataacgccggcttggtgtggatactacgactcaattcatcttcacttcatccctgaaatgtttgcaatgaagagtgcattccggtttttcaacagctgttacagtcatttcatgagtgctctggatgaggcttccagctcgggttgccaatatttacttgtggaagtgataaagacaaaaatggccgcaggctgttacccctgcggccggtttcgggcgcatattgccatcacggcagcctgacgcccgttttcaccttacttccggttacgccaccagccgacaatcgctgcggtaataattcccgccaggatcggtgccgccaggtcgtgccagaaagtcatggcaaactgcgcgagcgtcatatagccgccttgttgtaatgacaacattttgcggctattcttgaagtgtctggtttcaagattagcccccgttctgttgtcaggttttacctctcaacgtgcgggggttttctctttccagcaaccaatgccaccagggataaagcccccgcaacattgcgcctcaccggataattccggcttggtgtggatactacgtctcaattcatcttcacttcatccctgaaatgtttgcaataaagagtacattccggcttttcaacagctgttgcagtcgtttcatgagtgctctggatgatgcttccagctcgggttgccaatatttacttgtggaagagataaagacaaaaatggccgcaggctgttacccctgcggccggtttcgggcgcatattgccatcacggcagcctgacgcccgttttcaccttacttccggttacgccaccagctgacaatcgctgcggtaataattcccgccaggatcggtgctgccaggtcgtgccagaaaatcatggcaaactgcgcgagcgtcatatagccgccttgttgtaatgacaacattttgcggctattcttgaagtgtctggtttcaagattagcccccgttttgttgtcaggttttacctctcaacgtgcgggggttttctctttccagcaaccaatgccaccagggataaagccccgcaacattgcgcctcaccggataacgccggcttggtgtggatactacgtcgcaattcatcttcacttcatccctgaaatgtttgcaatgaagagtacattccggcttttcaacagctgttgcagtggtttcgtgcagggtgtggtacaggctcgcaattctgattaacgacctgtccaggtagtatgaagaaatacaataagcaggaatttatattatctcccccgattaccgtcatcggaggagatataactgtcaggcaaatatcgtcatcaaataggcggcaaacagtgccagatgcgctgcgccattgagcacgttagtacgtccggtggagaaggagatatggcacagcactaaagaggccaccatcaccaccatttctggcgcaccaagtgcaaactgcaattcgttacccgtcataaaggcaattagcgtgacgacaggtacggtaagcgaaatggttgctaacactgaaccaaagaacagattcatcgcgcgctgaacctggttgttcaacactgcttttaatgcacctaaaccttccggcgacagaatcaacagtgccaccaggaagccagtaaaggcgacaggggcattcatgctgtcgagcaatgtctccagcgagctggcgttcattttggtcaccgcaataacggcaatcagatggataatcaaccagatagcatgccacaggctgctatgggcagacggtttaccgtgatgcgggtcgtcatcatcactgtcatcttcgtgctcgtagacaaacaaactttgatgcgttttggtctggatcagcaaaaatacgccatacattgccgcagaaattaatgctaccagtaacgcctgaccggttgaaaaattcgccgcaggcagagccattggaaataccagtacgattatcgccagggggaacagcgcaattaaatactgcttgataccaaacagattcatatattgggtggcaaacttacgaccgcccaacaataatgaaaagccaaccagcccaccggtaacaatcataatgattgaatagagcgtatcacgcattagcgttggcgcggcgtcgccggttgccattaaagctgaaatcaaactgacttcaagaataaccactgaaaggctaagaataagcgaaccgtaaggttctcccaggcgatgggctaatacgtccgcatgacggacaacactaaaggcgctacttaaaataccaataagcgcaagaagattgatggcaatgaccactggtagtgtctggctgcttccccacaggaacagcactaccagcgccagaaccgggaaaataagcgaagtctccttgtggcgggtttttaccgcctcttgagcatttgacattatggttatccctttgcagatgaatttatcgaaaatgtaaaaaataggtaggaaaaataacagaaagtgtctggatatcggtaacattttacgaatttttaccccgctgtcgattttttactcattggggcataaaaataagtattacgtttagacaatgtttgttttagcgtctcttaagaagagtctgacctgaaaattcttatgttttggcaagagtagatattgttgaccacacttaatgttcaactttgtaaaaggagtcaacgatgccgtataaaacgaaaagcgatctgccggaaagcgtaaagcacgttctaccgtctcatgcccaggatatctataaagaagcgttcaacagcgcatgggatcaatataaagataaagaagatcggcgtgatgacgccagtcgcgaagaaaccgcgcataaagtggcctgggctgctgtgaagcatgaatatgccaaaggggatgatgataaatggcataaaaaatcgtaaaaccggtcgcttagttaaagctattcgtgcggtgttgccttgcaagtggtccgtggattgcatattgtcccgttagtggtttcaaaatgagcagtaaaaatgtccggaagacaccaaaaagttgtcgcagggaagtatgcagtggcggaagtgtaaggtgataacgcgtgatttcttgatgaatgccgattgtaaaacggcatttggtgccattgaagaatcactcttatggtcagcagaacaacgggcggcttcgctggcggcgacgctggcttgtcgacctgatgagggaccggtgtggatcttcggctatggatcgttgatgtggaatccggcactggagtttaccgaatcgtgcaccggtacactggttggatggcatcgcgcattttgcctgcgcctgaccgccgggcgcgggactgcgcaccagccgggacggatgcttgcactgaaagagggcggacgcaccacaggcgtcgcctatcgactgccagaagagacgctggagcaggaactaaccctgttgtggaagcgagagatgattaccggctgttatctgccaacctggtgtcagcttgatcttgatgatggacgcacagtaaacgccattgtgtttattatggacccgcgacatccagaatatgaatctgatactcgcgctcaggtcatcgcgccgttgattgcggcggcgagcggtccgctgggaaccaacgcacaatacctgttttcactggaacaggagcttatcaaactgggaatgcaggacgatgggctgaatgatttgctggtatcggtaaaaaaactgctggcggagaattttccggatggtgtgttacgtccgggattcgcctgagtaaacttcccgcatagtggggcgtcagacgccccctcaaacattaaaatgtgagcactttatcggctgacagcgtccattgcgccagttccacaagagtaccgatttccaccccatcaatcagaggaagtgtactaatcccgcgcccgtcggtacaggttttgcacaatttcaccggtacattctgagcggtaaggatctccagcatttgctgaatgttgtagccttcccctggtttttgcccgcgcaacccggctgtgaccgcatcagacatgaggaacagacgcagatccagattgctctcctgctctcgtaacgcaatggccagccgcaagctgttaaacaaggattcgctcccgtaaggtgcgccattggcaacgatcacgattttttgcattatttactcctgtattcagggaattagacactcatcttctatcttactgcttctgcagcgtctgaccaatcggtcacatttttaaggattttcctgaaagcgcgagaaaatacgacaaaagttgccagtaatcgttattctttaaggctatggtttttcattattaccggaagttaccgacgttttgagccgtttcgttcctcgcattatcccgttttatttactcttgcttgtagcaggcggtacagctaacgcacaatctaccttcgagcaaaaagcggcaaatccctttgataataacaatgatggtctgccggatttaggcatggctcccgaaaatcatgatggggaaaaacactttgctgaaattgtgaaagatttcggcgaaaccagtatgaatgataacgggctggatactggcgagcaggcaaaagctttcgcattgggaaaagtccgcgacgcgcttagtcaacaggttaatcagcacgtagagtcctggctatcaccgtggggaaatgccagtgttgacgtcaaagtggataacgaaggacatttcaccggcagtcgtggaagctggtttgtgccgttacaagataatgatcgttatctcacctggagccagcttggtcttactcagcaggataatgggttggtgagcaatgtgggcgttgggcaacgctgggcgcgcggcaactggctggtgggttataacactttttatgacaacttgctggacgaaaatcttcagcgagcgggctttggtgccgaagcgtggggcgaatatttgcgattatcggcaaacttttatcagccgtttgctgcatggcatgaacagacagccacgcaggaacaacggatggcgcgcgggtacgacctgacagctcggatgcgcatgccgttctatcaacacctcaataccagtgtcagcctagaacagtattttggtgatcgtgttgatttgtttaactctggtacgggttatcacaatcccgtcgcgttgagtctgggattaaattacacccctgtgccattagtcactgtgacggcccagcataaacagggtgaaagtggcgaaaatcaaaataacctcgggctgaatcttaattaccgctttggtgtaccgctcaaaaaacaactttctgcgggcgaggttgccgaaagtcagtcgttacgtggtagtcgctatgacaatccgcagcgaaataatctaccgactcttgagtaccgacagcgaaaaacgttaacggtgtttctggcgacaccgccgtgggatctaaaacctggcgaaacagtgccgctgaaattacaaatccgcagtcgttacggtattcggcaactgatttggcagggcgatacgcagatattaagtttgacgccgggcgcacaagccaacagcgcggagggctggacgctgatcatgcctgactggcagaacggggaaggggcaagcaatcactggcgattgtctgtggtggtggaagataaccaggggcagcgtgtctcctccaatgagatcacgctaacgcttgtcgaaccgttcgatgcattgtcaaacgacgaactgcgctgggaaccgtaatcagaaaatgcgctcctgatgcacccataccgctgcttccacgcgagacttgagcttcattttcttcagcatgtgcttgacgtgcacttttactgtgctttcggtgatatccaggcggcgggcaatcatcttgttcggcaaaccctgggcaatcagcttgagaatatcgcgctcgcgtggggttaactggttaacatcgcgctcagtagtggcacggttagcgcgcaagctggcggccagaacaggcgttaatgcttcgcttaataccatttcgccagcagctgcctgatgcaatgctttcagcagatcttccggttccatatcttttaacagatagccatccgcgccgcgtttcagtgcggtgaccacatcttcttcatggttagagacgctgaataccacaatgcgccctgagagggacttttcgcgcagtttatccagcgtttccagaccgttcatgccgggcatattgagatctaacaggatcagatcgggatcaagagactccgccagttcaataccctgttcgccattactcgcttcgccaaccacggtgatatctggtgccatactgataagctgttttacgccagttcgcagcatcgggtgatcgtcaatcagcaggatagtagccggttcctgattactcatgggtatctccttggacgtctgtgaaagttttttcgggaataaaggtgaccaccacttcggtgccacctgattcacgacggcggacgcggcaatcgcctcgtaaactttgcgcacgatcgcgcattattatcatgccgtagtgattgctgcggatggcattttcaggcacgccgcagccgttatcctggacggtcagtttgacctgattatcgttttgcgccaccgtcaccacgacttcactcgcttgcgaatgtttgagggcgttacttaatgcctcacgggcaatttgcaacaagtggattgcctgatgcgaaggcaccaggcgaggcggcaattgataatccagcttcaccgggaagccaaatttggcgctgtactcttcgcaactcgcctccagcgccggacgtaatccaggctcggtgagctgcaagcggaatgtggtgagcaattcacgcaactgcgcccaggatgcattcagttcgttacggatctgacttaacagttcgcggctgctttctggcagcgcatcgccctgcatctgtaaacaactcacctgcatcttcatgcaagagagagattgggcaatagaatcatgcagttcgcgcgcaatggtggcacgctcttccatcacgatcaactgttgctgacgttcctgatggcgatccagcgccagcgtggcggtgagttgttcaaccagggtatccaccagttgttgttgatcatggctaagatgacgcccctgcggcagggtcgccagcaaaataccgtactgcgtatgagagtcagccagccgccacttcagggtcgtgccgcgatcaccaacgggtaatacgccgcgcgggcagagctggcagcctttatcatcacaagtcatatctggctggcaggtaaactcctgatgattctcttcatcatcagtgtcatacacccgcaattcgatatcacgtagcagggttaaattctgtaagccgttgagtacaggtgacaggcgttcacacagcggggcgcgggaatgcaaacggcggttagcctgccataaaaaagagaggatctgatttttatgctccagcccggcggttttctcctgaacccgctgctcaagtacggcataactttcggccagttctgcagacatattgttcaacgcagttccaagcatcgccatttcgttgcgcccgctgatgtttgcgcgttgggtaaaatcgcgatgactgacggcactcgccattgccagcagttgccgccacggttgtagcagtcgcgcccgcaaccagataatagtgaacaccagtaaaagtgccataaataccgccattacccgatggaccagtaccactgtctcgatgcgcatttccgtggtgcggtcaaaaccagataccagttgatcaagcccggcaacaaactggctgacatccgctgacaccgtttctcggttttgtgcacgcatcagcgcagggatcagttcattacgccagtaatcttgtaaaccctgtaattgcgccagttgtccgtctcgttctgctgctcgagtcaactcggcgctaaatgccgtttgttccatctctttaattaagggcttgtctttctcgcttaatggcactgccgccaacagacggtaactttgcatgcgcagcgatcccgctttgttgatcgcatgggcgctgccctgaacgccttgcaccagccagccagaaaccgccatccctgccagtccaatagcagtagaaagcaacacaataagcgcaacctgattaaccagggtgagcggagagagacaacgtttaagcatgtaaacctcttccttcaggctttaaatgagcaataaccttaatgaatgtgacgatacattctggaatggcagtattctcggctattggctgaagtatacccatacccggaaagagttactccttatttgccgtgtggttagtcgctttacatcggtaagggtagggattttacagcaccgtgaaaaatctcataatttttatgaagtcactgtactcactatgggtaatgataaatatcaatgatagataaagttatcttatcgtttgatttacatcaaattgcctttagctacagacactaaggtggcagacatcgaaacgagtatcagaggtgtctatgagtcactcatccgcccccgaaagggctactggagctgtcattacagattggcgaccggaagatcctgcgttctggcaacaacgcggtcaacgtattgccagccgcaacctgtggatttccgttccctgtctgctgctggcgttttgcgtatggatgttgttcagcgctgttgcggtgaacctaccgaaagtcggctttaattttacgaccgatcagctatttatgttgactgcgctgccttcggtttctggcgcgttattacgtgttccatactcctttatggttcctatcttcggtggtcgtcgctggacggcgttcagcaccggtattctgattattccttgcgtctggctgggttttgccgtgcaggatacctccacgccttatagcgtcttcatcatcatctctctgctatgcggctttgctggcgcgaacttcgcatccagtatggcaaacatcagcttcttctttccgaaacagaagcagggtggcgcgctgggtctgaatggtggtctgggaaacatgggcgtcagcgtcatgcagttggttgctccgctggtggtatcactgtcgattttcgcagtatttggtagccagggcgtcaaacagccggatgggactgagctgtatctggcgaatgcgtcctggatatgggtgccgttccttgccatcttcaccattgcggcgtggtttggcatgaacgatcttgctacctcgaaagcctccatcaaggagcagttgccggtactcaaacggggtcatctgtggattatgagcctgctgtatctggcaaccttcggctccttcatcggcttctccgcgggctttgcaatgctgtcaaaaacgcagttcccggatgttcagattctgcaatacgctttcttcgggccgtttattggtgcgctggcgcgttctgcaggtggtgcattatctgaccgtctgggcggaactcgtgtcacgctggtgaactttattctgatggcgattttcagcggcctgctgttcctgaccttaccgactgacgggcagggcggaagcttcatggcgttcttcgcggtcttcctggcgctgttcctgacagctgggctgggtagtggttccactttccagatgatttcagtgatcttccgtaaactgacaatggatcgcgtgaaagcagaagggggttctgacgaacgtgcgatgcgtgaagcggcaaccgacacggcggcggcgctgggtttcatctctgcgattggcgcgattggtggcttctttatcccgaaagcgtttggtagctcgctggcattaacgggttcgccagtcggcgcaatgaaggtatttttgattttctatatcgcctgcgtagtgattacctgggcggtatatggtcggcattctaaaaaataaaccgttactcgtcatacttcgggttacatgtgctgcggctgcgttcattcaccccagtcacttactttagtaagctcctgggattcattcacttgccgccttcctgtaaaccgaattatatagagtaaaatatttgattatcctttgcgcggcatgatgtcgcgctttttttatgcgtcatttagttacaacatactaatgttatatggtttatttcgccggatttcattaagagccattaatatgttacccatggggaatactccttaatacccatctgcataaaaatcttaatagtttaaataactacaggtataaaacgtcttaatttacagtctgttatgtggtggctgttaattatcctaaaggggtatcttaggaatttactttatttttcatccccatcactcttgatcgttatcaattcccacgctgtttcagagcgttaccttgcccttaaacattagcaatgtcgatttatcagagggccgacaggctcccacaggagaaaaccgatgagtaaattcctggaccggtttcgctacttcaaacagaagggtgaaacctttgccgatgggcatggccagcttctcaataccaaccgtgactgggaggatggatatcgccagcgttggcagcatgacaaaatcgtccgctctacccacggggtaaactgcaccggctcctgcagctggaaaatctacgtcaaaaacggtctggtcacctgggaaacccagcagactgactatccgcgtacccgtccggatctgccaaaccatgaacctcgcggctgcccgcgcggtgccagctactcctggtatctttacagtgccaaccgcctgaaatacccgatgatgcgcaaacgcctgatgaaaatgtggcgtgaagcgaaggcgctgcatagcgatccggttgaggcatgggcttctatcattgaagacgccgataaagcgaaaagctttaagcaggcgcgtggacgcggtggatttgttcgttcttcctggcaggaggtgaacgaactgatcgccgcatctaacgtttacaccatcaaaaactacggcccggaccgtgttgctggtttctcgccaattccggcaatgtcgatggtttcttacgcatcgggtgcacgctatctctcgctgattggcggtacttgcttaagcttctacgactggtactgcgacttgcctcctgcgtctccgcaaacctggggcgagcaaactgacgtaccggaatctgctgactggtacaactccagctacatcatcgcctgggggtcaaacgtgccgcagacgcgtaccccggatgctcacttctttactgaagtgcgttacaaagggaccaaaactgttgccgtcacaccagactacgctgaaatcgccaaactgtgcgatctgtggctggcaccgaaacagggcaccgatgcggcaatggcgctggcgatgggccacgtaatgctgcgtgaattccacctcgacaacccaagccagtatttcaccgactatgtgcgtcgctacaccgacatgccgatgctggtgatgctggaagaacgcgacggttactacgctgcaggtcgtatgctgcgcgctgctgatctggttgatgcgctgggccaggaaaacaatccggaatggaaaactgtcgcctttaataccaatggcgaaatggttgcgccgaacggttctattggcttccgctggggcgagaagggcaaatggaatcttgagcagcgcgacggcaaaactggcgaagaaaccgagctgcaactgagcctgctgggtagccaggatgagatcgctgaggtaggcttcccgtactttggtggcgacggcacggaacacttcaacaaagtggaactggaaaacgtgctgctgcacaaactgccggtgaaacgcctgcaactggctgatggcagcaccgccctggtgaccaccgtttatgatctgacgctggcaaactacggtctggaacgtggcctgaacgacgttaactgtgcaaccagctatgacgatgtgaaagcttataccccggcctgggccgagcagattaccggcgtttctcgcagccagattattcgcatcgcccgtgaatttgccgataacgctgataaaacgcacggtcgttcgatgattatcgtcggtgcggggctgaaccactggtatcacctcgatatgaactatcgtggtctgatcaacatgctgattttctgcggctgtgtcggtcagagcgggggcggctgggcgcactatgtaggtcaggaaaaactgcgtccgcaaaccggctggcagccgctggcgtttgcccttgactggcagcgtccggcgcgtcacatgaacagcacttcttatttctataaccactccagccagtggcgttatgaaaccgtcacggcggaagagttgctgtcaccgatggcggacaaatcccgctataccggacacttgatcgactttaacgtccgtgcggaacgcatgggctggctgccgtctgcaccgcagttaggcactaacccgctgactatcgctggcgaagcggaaaaagccgggatgaatccggtggactatacggtgaaatccctgaaagagggttccatccgttttgcggcagaacaaccagaaaacggtaaaaaccacccgcgcaacctgttcatctggcgttctaacctgctcggttcttccggtaaaggtcatgagtttatgctcaagtacctgctggggacggagcacggtatccagggtaaagatctggggcaacagggcggcgtgaagccggaagaagtggactggcaggacaatggtctggaaggcaagctggatctggtggttacgctggacttccgtctgtcgagcacctgtctctattccgacatcattttgccgacggcgacctggtacgaaaaagacgacatgaatacttcggatatgcatccgtttattcacccgctgtctgcggcggtcgatccggcctgggaagcgaaaagcgactgggaaatctacaaagccatcgcgaagaaattctccgaagtgtgcgtcggccatctgggtaaagaaaccgacatcgtcacgctgcctatccagcatgactctgccgctgaactggcgcagccgctggatgtgaaagactggaaaaaaggcgagtgcgacctgatcccaggtaaaaccgcgccacacattatggtcgtagagcgcgattatccggcgacttacgaacgctttacctctatcggcccgctgatggagaaaatcggtaatggcggtaaagggattgcctggaacacccagagcgagatggatctgctgcgtaagctcaactacaccaaagcggaaggtccggcgaaaggccagccgatgctgaacaccgcaattgatgcggcagagatgatcctgacactggcaccggaaaccaacggtcaggtagccgtgaaagcctgggctgccctgagcgaatttaccggtcgtgaccatacgcatctggcgctgaataaagaagacgagaagatccgcttccgcgatattcaggcacagccgcgcaaaattatctccagcccgacctggtctggtctggaagatgaacacgtttcttacaacgccggttacaccaacgttcacgagctgatcccatggcgtacgctctctggtcgtcagcaactgtatcaggatcaccagtggatgcgtgatttcggtgaaagcctgctggtttatcgtccgccgatcgacacccgttcggtgaaagaagtgataggccagaaatccaacggcaaccaggaaaaagcgctcaacttcctgacgccgcaccagaagtggggtatccactccacctacagcgacaacctgctgatgctgactttaggtcgcggtggtccggtggtctggttgagtgaagccgatgccaaagatctgggtatcgccgataacgactggattgaagtcttcaacagcaacggtgctctgactgcccgtgcggttgtcagccagcgtgttccggcagggatgaccatgatgtaccacgcgcaggaacgtatcgttaacctgcctggttcggaaattacccaacagcgtggtggtatccataactcggtcacccgtatcacgccgaaaccgacgcatatgatcggcggctatgcccatctggcatacggctttaactactatggcaccgtaggttctaaccgcgatgagtttgttgtagtgcgtaagatgaagaacattgactggttagatggcgaaggcaatgaccaggtacaggagagcgtaaaatgaaaattcgttcacaagtcggcatggtgctgaatctcgataagtgcatcggctgccacacctgttcagttacctgtaaaaacgtctggaccagccgtgaaggcgtggaatatgcgtggttcaacaacgtggaaaccaagccgggccagggcttcccgactgactgggaaaaccaggaaaaatacaaaggcggctggatccgtaaaatcaacggcaaactgcagccgcgcatgggtaaccgtgccatgctgctgggtaaaatcttcgctaacccgcatctgccggggatcgacgattattacgagccgttcgattttgactatcagaacctgcataccgcgccggaaggcagcaaatcgcagccgattgcccgtccgcgttcgctgattaccggggaacggatggcgaaaatcgaaaaagggccgaactgggaagatgacctgggcggtgagtttgacaaactggcgaaagacaagaacttcgacaacatccagaaggcgatgtatagccagttcgaaaacaccttcatgatgtatttgccgcgcctgtgcgaacactgcctgaacccggcatgtgtggcgacctgcccgagcggtgcgatttacaagcgtgaagaagatggcatcgtcctgatcgaccaggataaatgccgtggctggcgtatgtgcatcactggatgcccgtacaaaaaaatctacttcaactggaagagcggtaagtctgagaagtgcatcttctgctatccgcgtattgaagcgggtcagccgaccgtgtgctcagaaacctgtgtcggtcgtatccgttatcttggcgtgctgttgtacgatgccgacgctattgaacgtgcagccagcaccgagaacgagaaagatctttaccagcgtcagctggacgtgttcctcgatccgaacgatccgaaagtcatcgagcaggcgattaaagacggtattccgctgagcgttattgaagccgcacagcagtcgccggtttataaaatggcaatggaatggaaactggcgctgccgctgcatccggaatatcgcacactgccgatggtctggtacgtgccgcctctgtctccgattcagtctgcagcagacgcgggtgagctgggtagcaacggcattctgccagacgtcgaaagcctgcgtattccggtacagtatctggcgaatctgctgaccgccggtgataccaaaccggtactgcgcgcactgaaacgtatgctggcgatgcgtcattacaaacgtgctgaaaccgttgacggtaaagttgatacccgtgcgctggaagaggtcggtctgaccgaagcccaggcacaggagatgtaccgttatctggcgattgctaactacgaagatcgctttgtggtgccgagtagtcatcgtgaactggcacgggaagccttcccggagaaaaatggctgcggctttacctttggtgatggctgccacggttcagataccaaattcaatctgttcaacagccgtcgtatcgatgccatcgatgtgaccagcaaaacggagccgcatccatgatcgaactcgtgattgtatcgcgtctccttgaatatccggatgctgccttatggcagcatcaacaagagatgtttgaggcgattgccgcgtcgaaaaatctgccaaaagaggatgcccatgcgctgggcattttcctgcgcgatttaacgacgatggatccgctcgatgcccaggcgcagtacagcgaactgttcgaccgtggccgcgccacgtcactgttgctgtttgaacatgtgcacggcgaatcccgcgaccgcggccaggcgatggtggacctgctggcgcagtacgagcagcacggcttgcagttaaacagccgcgaattgccggaccatctgccgctgtatctggagtacctggcgcagctgccgcaaagcgaagccgtggaaggtttgaaagatatcgcgccgattctggcattgctgagcgcgcgtctgcaacagcgtgaaagccgttatgccgtgctgtttgatctgctgctgaaactggcgaataccgctatcgacagcgacaaagtggcggaaaaaattgccgacgaagcgcgcgatgatacgccgcaggcgctggatgctgtctgggaagaagagcaggttaaattctttgctgacaaaggctgcggtgattcagcaatcactgcgcatcagcgtcgctttgccggtgccgtcgcgccgcaatatctgaatatcaccaccggaggacagcactaatgcaattcctgaatatgttcttctttgatatctacccgtacatagccggggcggtcttcctgattggtagctggctgcgttatgactacgggcagtacacctggcgcgcggcgtccagccagatgctggatcgcaaagggatgaacctggcgtcgaacctgttccatatcgggattctggggatttttgtcggtcacttcttcggtatgctgacgccgcactggatgtatgaagcctggctgccgattgaagtgaaacagaaaatggcaatgtttgctggtggtgccagcggcgtgctgtgtctgattggcggcgtgctgttgctgaaacgtcgtctgttcagcccacgcgtgcgtgcaaccactaccggagcggatatcctgatcctgtcgctgctcgttatccagtgcgcgctgggcctgttgaccattccgttctccgctcagcatatggacggtagcgagatgatgaaactggttggctgggcgcagtcggtggtgaccttccacggtggcgcttctcaacacctcgatggtgtggcgtttatcttccgtctgcacctggtgctggggatgacgttattcctgctgttcccgttctcgcgtctgatacacatctggagcgtaccggtggagtatctgacacgtaagtaccagctggtgcgcgctcgtcactaagcgaattttagttcacatagaccctgcttcggcggggtttttttatgggcacggtgcggggtgagttgtcggatgcgcttcgcttatccgacctacaggggaggatattgtaggcccggtaaacgtggtgccatcgggcaaaattagctcggagtaacaggttttgattatttaaggaagcgatggtggtgggggaaggattactcagcgctgcgcgcttcgcccttcgggtcgttgcctgcggcaacgctctctcgctggcgctcaagtcgaaccttggtcgaagcttctcatccttccccgcttgggcagaatatttgattgcggattcgtttgagaattccggggcttttgaaagtgatggtggtgggggaaggattactcagcgctgcgcgcttcgcccttcgggtcgttgcctgcggcaacgctctctcgctgacgctcgagccgaaccttagtcgaagcttctcatccttccccgcatgggcagaatatttgattgcggattcgcttgagagttcagggacttttgaaagtgatggtggtgggggaaggattactcagcgctgcgcgcttcgcccttcgggtcgttgcctgcggcaacgctctctcgctggcgctcgagtcgaaccttggtcgaagcttctcatccttccccgcatgggcagaatatttaattgcggattcgttgggaagttcagggacttttgaaagtgatggtggtgggggaaggattcgaaccttcgaagtcgatgacggcagatttacagtctgctccctttggccgctcgggaaccccaccaggggtaattcaaattttgaggtaatgcttgagatggtggtgggggaaggattattcgtcgcttcgctcctcacccttcgggccgttgcctgtggcaacgttctctcgctttcgctcgaatcgaaccttagtcgaaggttctcacccttccccgatgagtgcaaactttcacaatctcaccgaagttaccacatcgctgtggtgaattatggtggtgggggaaggattcgaaccttcgaagtcgatgacggcagatttacagtctgctccctttggccgctcgggaaccccaccacggggtaatgctttttactggcctgctcccttatcgggaagcggggcgcatcatatcaaatgacgcgccgctgtaaagtgttacgttgagaaaaatgaactggttgcgtaattttcatccgtaacggattaaaggtaaccagttatttttgctggcgattaaagaataatcgttcgattaccgtaaacaaagacgcgctgtgccagtactttgtatagtgcacgacttaagacgtttttctcgacgtcacgacctgcgcgcatcatatcttcagctgtgtaggtatgatcgacatgaataacgtcctgcatgatgattgggccttcgtccagattgtcattcacatagtgagcggttgcgccaataatcttcacaccacgttcataggcctggtgataaggacgtgcgccaataaacgctggcaggaatgaatggtgaatattgatgatcttattcgggaagcgtgccacaaattccggcgttaatacccgcatatacttcgccagcaccacgtagtcaggttgataagcatcaatggcatccgccatcttttgatcgtgctcgttgcgggttaacccttcatggcttaccagctcaaacggaatatcaaaacgctcaaccagagaacgtaaagtatcgtggttaccaataactgccgcgatttcgacatccaggccgccgtaattggctttcatcaacaaatcgccaaggcaatgcgcttctttagtgaccagaatcactatccggcgacgaccggcaggattcagctcacgcacggagccttctggcaatgcgctatcgagatccgccagcagggtggaatcattaaaaatcccttccagttccgtgcgcataaaaaagcgcccggtacggtgatcaacaaattcattgttctgtacgatatttaactcgtgcttgtagcaaatattggtaatacgtgcgatcagacctttttggtccggacaaatagtacgcagaactttacgttggagtgaatgcattgctggaaaaaccttgttgagagtgtttgctaaaccgtaccgtcaaccattattggccgcagcactttttaaattttttacctgaaccacaagggcagggatcgttgcgaccaaactgcggacgtgtaccgtcaatatagtaccattgaccgttttctttcaaaaatcgcgaacgttcaattattgcacctgttttaccaccttcggtaaatcgagcaacaaaactgacaaatccgatattgtcggcgtcctgccaacaatgttcaaatacggtcaatcccaaccattcagtatgcgcaaatccggccatcaattcggcacgtaacgccgctgctccacaagagggatgccaggtctttattaaataatctgcgtcttgcatcacaaaagcgcagtaacgcgaacgcatgagatgttctggatcaggtgcaaccttttcaccagacacataagggtggcaacataggctatactcgacagcactaccacagggacaaagctgagacacaaataatctccctggaaacaataacggcgtattaaccgcctgagtagcactatgttaaccgagcagtagcgatgtggctacgattgcattccaggggaatcttgcgggaataatgagaaagataaaaatagggctggcgctgggatctggcgcggcgagaggttggtcgcatattggcgttattaatgcgctaaaaaaagtgggtattgaaattgatatcgttgcaggatgttcaattggttcgctggtgggcgctgcctatgcatgcgatcgattatctgcgctggaagattgggtgacctctttcagttattgggatgttttacgcctgatggatctctcctggcagcgcggtgggttactgcgcggcgagcgtgtcttcaatcaataccgcgaaataatgccggaaacagagatcgaaaattgttcccgtcgctttgcggctgttgccaccaatttaagtacgggacgtgaattatggtttactgaaggcgatctccatcttgctattcgcgcatcatgcagtattccaggactcatggcacctgttgcacataacggctactggctggttgatggagcagtcgttaacccaattcctatttccctcacgcgtgcattgggggctgatattgtgatagcggttgacctgcagcacgatgctcatttgatgcaacaagatttgctctcctttaatgtcagtgaagaaaatagcgagaatggtgattctctgccgtggcatgcgcgtctgaaagaaaggttaggcagcataacgacacgtcgggcggtgacagcgccaacggcaacagagattatgaccacttctatccaggtgctggagaaccgccttaaaaggaaccgcatggcaggtgatccgcccgatattctgattcaacctgtttgcccgcaaatatctacgcttgatttccatcgcgcgcacgctgccattgcggccggacagctggcagtggaaaggaaaatggacgaacttttgccgttggtacgcaccaacatttgaccagaatttttatctacacttaagttaattctgacaggcgcaggtggcaatagcatgccactattgagtaaagccagtcaggggagagaacatgacgcagccattggtcggaaaacagattctcattgttgaagatgagcaggtatttcgctcgcttctggattcatggttttcctcattgggagcgacaacggtactggcggctgatggggtggatgcccttgagttgctgggaggtttcactccagacctgatgatatgtgatatcgcgatgccacgaatgaacgggcttaaactgctggagcatatacgtaacagaggcgaccagaccccagttctggtgatatctgccactgaaaatatggcagatattgccaaagcgttacgtctgggcgttgaagatgttttgctgaaaccagttaaagatctgaatcgcttgcgcgagatggtttttgcctgtctctatcccagcatgtttaattcgcgcgttgaggaagaggaaaggctttttcgcgactgggatgcaatggttgataaccctgccgcagcggcgaaattattacaggaactacaaccgccggttcagcaggtgatttcccattgccgggttaattatcgtcaattggttgccgcggacaaacccggcctggtgcttgatattgccgcactttcggaaaacgatctggcattttattgccttgatgtcacccgagctggacataatggcgtacttgctgccttgttattacgcgcattgtttaacggattattacaggaacagcttgcacaccaaaatcaacggttgccagagttgggcgcgttattgaagcaggtaaaccatttacttcgtcaggccaatctgccggggcagtttccgctattagttggctattatcatcgcgaactgaaaaatctcattctggtttctgcgggtctgaatgcgacgttaaataccggcgaacaccaggtgcaaatcagtaatggtgttccgttaggcactttaggtaacgcttatttgaatcaattgagccagcgatgcgatgcctggcaatgccaaatatggggaaccggtggtcgactgcgcttgatgttgtctgcagaatgagcaaacgataacgcgggctaaatttgcattacctgctaatgtcggctggtggtactatcgtcgccattcgtataagtaattgtcttaattatgctaactcgcctccttttcagaacttagccccttcggggtgctgatatactgggatgcgatacagaaatatgaacacgttcaaaacacgaacagtccaggagaatttaaatggctgccattaatacgaaagtcaaaaaagccgttatccccgttgcgggattaggaaccaggatgttgccggcgacgaaagccatcccgaaagagatgctgccacttgtcgataagccattaattcaatacgtcgtgaatgaatgtattgcggctggcattactgaaattgtgctggttacacactcatctaaaaactctattgaaaaccactttgataccagttttgaactggaagcaatgctggaaaaacgtgtaaaacgtcaactgcttgatgaagtgcagtctatttgtccaccgcacgtgactattatgcaagttcgtcagggtctggcgaaaggcctgggacacgcggtattgtgtgctcacccggtagtgggtgatgaaccggtagctgttattttgcctgatgttattctggatgaatatgaatccgatttgtcacaggataacctggcagagatgatccgccgctttgatgaaacgggtcatagccagatcatggttgaaccggttgctgatgtgaccgcatatggcgttgtggattgcaaaggcgttgaattagcgccgggtgaaagcgtaccgatggttggtgtggtagaaaaaccgaaagcggatgttgcgccgtctaatctcgctattgtgggtcgttacgtacttagcgcggatatttggccgttgctggcaaaaacccctccgggagctggtgatgaaattcagctcaccgacgcaattgatatgctgatcgaaaaagaaacggtggaagcctatcatatgaaagggaagagccatgactgcggtaataaattaggttacatgcaggccttcgttgaatacggtattcgtcataacacccttggcacggaatttaaagcctggcttgaagaagagatgggcattaagaagtaacatccgtatcggtgttatccacgaaacggcgttgagcaatcgacgccgtttttttatagcttattcttattaaattgtcttaaaccggacaataaaaaatcccgccgctggcgggattttaagcaagtgcaatctacaaaagattattgcttgatcaggaaatcgtcgagggatttaccttgctcatccattgcttttttgattacagctggagtacggccttggccagtccaggttttagtttcgccgttttcgtcaacgtagctatattttgccggacgctgagcacgtttagctttggtgccagatttaacggcagcaaggctattcagcagttcgttcgggtcaataccgtcagcgatcagcatttcgcgatattgctgcagtttacgagtgcgctcttcaacttcagcagcagccgcgctttcttcttcgcgacgttcgttaacaacaacttctaatttttccagcatttcttccagcgtttcaagtgtacattctcttgcctgcgcacgaagagtacggatgttgttcagaattttaagtgcttcgctcattgtagtaatctcaaacttatattggggtggtttgttgaggtaataatagagccttaaattcagttgtgcaatagccaggaatgtaaggaattcaaaattgttctttattttgtgccgccaataaatatcttttcataaaattagccagaaaagacgcggcatatagccctatttacaccgatgatttcgcagcacgtgaggttaaaacttcctgattcatgtcacattttatggggagattatcgtaggctgacgacctttcagtcttctgtattagttgtgtttacgagaattccctattaagcgaatgatgaaaagtagaacagtcgcaataagagcatggacttagtattgcactatctcctggaggtcaacagagggctattacttgcgcaacaggttaaagattgtgaatagttaccagcagtcatttacccgcttataacaagcgaggcagttgtaatgatagctcagaaggattatgcaaggcttcgtaagggagaacgcatatacccacttctgtgcatactgttgagctgaaaaactgacgaattatgataaactccagccaactttatttcatatcattgagggcctgtggctgatggcacagctatatttctactattccgcaatgaatgcgggtaagtctacagcattgttgcaatcttcatacaattaccaggaacgcggcatgcgcactgtcgtatatacggcagaaattgatgatcgctttggtgccgggaaagtcagttcgcgtataggtttgtcatcgcctgcaaaattatttaaccaaaattcatcattatttgatgagattcgtgcggaacatgaacagcaggcaattcattgcgtactggttgatgaatgccagtttttaaccagacaacaagtatatgaattatcggaggttgtcgatcaactcgatatacccgtactttgttatggtttacgtaccgattttcgaggtgaattatttattggcagccaatacttactggcatggtccgacaaactggttgaattaaaaaccatctgtttttgtggccgtaaagcaagcatggtgctgcgtcttgatcaagcaggcagaccttataacgaaggtgagcaggtggtaattggtggtaatgaacgatacgtttctgtatgccgtaaacactataaagaggcgttacaagtcgactcattaacggctattcaggaaaggcatcgccacgattaataagaatttctttactgacagggtgagcagggcacttttatcctgtcagttcgttttacgcacttcttccgggctatatacccttctcggcagttttttaacgccgctatacgcctcacagggctcttaagcaccgacgttgacttgtgacctgtaaagtacaatatccctgtgtttaggcgttatacatcgtcgcaaatatgatgaaggctaatgctgtcggtttatggaaaagttgctttgggtaaacaaaaaatacggccccagaagggcaatgccgttcacttaagaggagcggcactatgtttcacaggataacgggtttttgatatcttaaccgacctcggccttgatggtcgggggcgttttgttatgaacaccacttccagagcaccccgaagatgctccagtcgtttcgggatggtccctggtgacgccgtgtttcccagctctatcatttctgatgcgatattcttccacgcaggcagtagccagtggcggttacaacccttctggttcagcgtcagcagcaggtcttcgctgtaaaaaagtttatcaaacaacgtaatagagttatccgggatggtggcgagcatggagtgggccagcacagtttcgctctgccggtaaggtgcggtcacggcattcagcagaatgtgacttcccaggttcattaaggccaccagacgcataaccgggtaggcgttctgccgcttagtggatgtgttggcagacccataatattcacgcagctcgggtttatcaggtgtcctgaactgtgcgccatcaatggcaaaaagttgcaggccgtgccagtcatccttcaggtaacgttccgcgcccctgtctgtgcggtctggcggaagagccattccactggggcggcccccacgcgctgacgcgcctgggtgacagcgctgcgggccagcaggttcatccccgcttcgccatccgcgctcaggttcagacggcgaacaacatcggtaattggctcattgcaccaccatccagataaccatgtcccccggtaaacgacggcggcgaacggtcgcatgagcagaaagcgtcaggcagtgttgtatccactcggtgggaaggtgttctgcaaatagttgtgcagagggcggaggcataagcggatggtcactgaaatcgagcagatcattgagaagtggcataagaaaacggctccctgttgtggaagccgttatagtgcctcagtttaaggatcggtcaactaatccttaactgatcggcattgcccagaaggggccgtttatgttgccagacagcgctactgattaagcggattttttcgcttttttctcagctttagccggagcagcttctttcttcgctgcagtttcaccttctacataatcacgaccgtagtaggtatccagcagaatctgtttcagctcggagatcagcgggtaacgcgggttagcgccggtgcactggtcatcgaatgcatcttcagacagtttatccacgttcgccaggaagtctgcttcctgaacgccagcttcacggatagatttcggaatacccagttcagctttcagcgtttccagccatgccagcagtttctcgatcttagcagcagtacggtcgcccggtgcgctcagacccaagtggtcggcaatttcagcataacgacggcgagcctgcggacggtcatactggctgaatgcagtctgcttggtcgggttgtcgttcgcattgtagcgaataacgttacaaatcagcagggcgtttgccagaccgtgcggaatatggaactgggaacccagtttgtgcgccattgagtgacatacacccaggaaggcgttcgcaaacgcgatacccgcgatagtcgctgcactgtgaacacgttcacgcgctaccggatttttagacccttcgtggtaggacgctggcagatattctttcagcagtttcagtgcctgcagagcctgaccatcagagaactcagatgccagtacagaaacataagcttccatggcgtgagttactgcgtccagaccaccgaaagcacacagggacttcggcatgtccataaccaggttggcgtcgacaatcgccatatccggagtcagcgcatagtctgccagcggatatttctgaccagtagcgtcgtcagttacaaccgcaaacggagtgacttcagaacctgtaccagaagtggtggtgacagcgatcattttcgctttcacgcccattttcgggaacttgtagatacgtttacggatatccataaagcgcagcgccagctcttcgaagtgagtttccggatgttcgtacataacccacatgatcttcgcggcgtccatcggggaaccaccacccagcgcgataatcacgtctggtttgaaggagtttgccagttctgcacctttacgaacgatgctcagggtcgggtccgcttctacttcgaagaagacttcagtttcaacgcctgctgctttcagtacggaagtgatctgatcagcataaccattgttgaacaggaagcggtcagtcacgatgagcgcacgtttgtggccatcagtaatcacttcatccagcgcgattggcagggagccacggcggaagtagatagatttcggaagtttgtgccacaacatgttttcagctcgcttagcaacggttttcttgttgatcaggtgtttcggaccaacgttttcagagatggagttaccaccccaagaaccacaacccagagtcagggaaggtgcgagtttgaagttatacaggtcaccgataccaccctgagacgctggggtgttaatcaggatacgcgccgttttcattttctgaccgaagtaagaaacgcgagccggttggttatcctggtcagtgtacaggcaagaggtatgaccgataccgcccatagcaaccagtttctctgctttttctaccgcgtcttcgaaatctttagcgcggtacattgccagagtcggggacagtttttcatgtgcgaacggttcgctttcatcaacaacggtcacttcaccgatcagaatcttggtgttttctggtacagagaagcctgccagttcagcaattttataggctggctgaccaacgatagccgcgttcagcgcaccgtttttcaggataacatcctgaacagctttcagctctttaccctgcaacagatagccgccgtgggttgcaaaacgttcacgtacagcgtcataaacagagtcaacaacaacaacagactgttcagaagcacagattacgccgttgtcgaaggttttggacatcagtacagatgcaactgcacgtttgatatcagcagtttcatcgataacaactggagtgttgcccgcgcctacaccgatagctggtttaccggagctgtatgcggctttaaccatgcccggaccaccagtcgcgaggatcaggttgatgtctgggtggtgcatcagtgcgttagacagttcaacagaaggttgatcgatccagccgatcagatctttcggagcaccggcagcgatagcagcctgcagaacgatatcagccgctttgttggtggcatcttttgcacgcgggtgcggggagaagataatggcgttacgggtcttcagactgatcagcgatttgaagatagcagttgaagtcgggttagtggtcggaacgataccgcaaataataccgattggttcagcgatagtgatggtaccaaaagtgtcgtcttcagacagaacaccacaggttttttcatctttataggcgttgtagatatattcagaagcaaagtggtttttgatcactttatcttcgacgatacccatgccggattcggcaacggccattttcgcgagtgggattcgagcatctgcagcagccagagcggcggcgcggaagattttgtctacttgctcttgagtgaaactggcatattcacgctgggctttttttacacgctctacgagtgcgttaagttcagcgacattagtaacagccataatgctctcctgataatgttaaacttttttagtaaatcatctgctcgaatacgagagtatagtcagtgcggtgatgatttgcttaacctatgaaaatcaaaagcttactcgcgctcacactcactgtgatttactaaaagagtttaaacattagagttattatctctaatgcgtcacttccaggtggcgtaagcaagattactcacttctgggtactgattacgtgatccaaatcaaatttttgcaaagctgacacctttcagcatcgcttttcgccattatagctaacagttaataaattgtagtatgatttggtggctacattagcatgttttgcacaactagataacaataacgaatgatagcaattttaagtagttaggaggtgaaaaatgctgtcaaaaggcgtattgtcagcgcgtcttttcaaccttatttatggctaacattatccggcttttgcttcggagctaaccgtgattcagaccttttttgattttcccgtttacttcaaatttttcatcgggttatttgcgctggtcaacccggtagggattattcccgtctttatcagcatgaccagttatcagacagcggcagcgcgaaacaaaactaaccttacagccaacctgtctgtggccattatcttgtggatctcgctttttctcggcgacacgattctacaactttttggtatatcaattgattcgttccgtatcgccgggggtatcctggtggtgacaatagcgatgtcgatgatcagcggcaagcttggcgaggataaacagaacaagcaagaaaaatcagaaaccgcggtacgtgaaagcattggtgtggtgccactggcgttgccgttgatggcggggccaggggcgatcagttctaccatcgtctggggtacgcgttatcacagcattagctatctgtttggtttctttgtggctattgcattgttcgctttatgttgttggggattgttccgcatggcaccgtggctggtacgggttttacgccagaccggcatcaacgtgattacgcgtattatggggctattgctgatggcattggggattgaatttatcgttactggtattaaggggattttccccggcctgcttaattaattcctttcaaatgaaacggagctgccatgctccgtttacttcgtcattatttttactttgttcccgcgcagttatcaaaagcaaaaggaataggtaaaaatattcttctcaaattacagttagttataaggatttccttaactgcttctcctcaccatcatgttattttcgccacatcataatcctgggcttgctgaagaataattgaaatgatattattaattccactgcctttggtagaggaaagtgctaaataataatcaattgttaaattattgtgcatttcactactggaactgtaatcagaaaagatagacatgcttagccaatctctatttgattgaattgaaagatgtttgttaaggcatggatgcaagctatagattctgatacggtcaataaaagagaattgcttaacaattttgcaaaatgtattggcgagtaagaaccgcatttggtactttccgggcaaccgccagacgattctttattggtaatgagaataattaacaattaaagagcgtcgcgaaagaataatgtgtctcgacaggggagacacagtacgaatcgacataaggtgatcgtctgaatcaccagaataaataaagtcggtgatagtaatacgtaacgataaagtaacctgacagcagaaagtctccgagcctgtgcagggtcccaatccgggattacacatgctggttaataccagtaattataatgagggagtccaaaaaacaatgaccaacatcaccaagagaagtttagtagcagctggcgttctggctgcgctaatggcagggaatgtcgcgctggcagctgatgtacccgcaggcgtcacactggcggaaaaacaaacactggtacgtaacaatggttcagaagttcagtcattagatccgcacaaaattgaaggtgttccggagtctaatatcagccgagacctgtttgaaggcttactggtcagcgatcttgacggtcatccagcacctggcgtcgctgaatcctgggataataaagacgcgaaagtctggaccttccatttgcgtaaagatgcgaaatggtctgatggcacgccagtcacagcacaagactttgtgtatagctggcaacgttctgttgatccgaacactgcttctccgtatgccagttatctgcaatatgggcatatcgccggtattgatgaaattcttgaagggaaaaaaccgattaccgatctcggcgtgaaagctattgatgatcacacattagaagtcaccttaagtgaacccgttccgtacttctataaattacttgttcacccatcaacttcaccggtgccaaaagccgctatcgagaaattcggcgaaaaatggacccagcctggtaatatcgtcaccaacggtgcctataccttaaaagattgggtcgtaaacgaacgaatcgttcttgaacgcagcccgacctactggaacaacgcgaaaaccgttattaaccaggtaacctatttgcctattgcttctgaagttaccgatgtcaaccgctaccgtagtggtgaaatcgacatgacgaataacagcatgccgatcgaattgttccagaagctgaaaaaagagatcccggacgaagttcacgttgatccatacctgtgcacttactattacgaaattaacaaccagaaaccgccattcaacgatgtgcgtgtgcgtaccgcactgaaactaggtatggaccgcgatatcattgttaataaagtgaaagcgcagggcaacatgcccgcctatggttacactccaccgtatactgatggcgcaaaattgactcagccagaatggtttggctggagccaggaaaaacgtaacgaagaagcgaaaaaactgctggctgaagcgggttataccgcagacaaaccgttgaccatcaacctgttgtataacacctccgatctgcataaaaagctggcgattgctgcctcttcattgtggaagaaaaacattggtgtaaacgtcaaactggttaaccaggagtggaaaacgttcctcgacacccgtcaccagggtacttttgatgtggcccgtgcaggctggtgtgctgactacaacgaaccaacttccttcctgaacaccatgctttcgaacagctcgatgaataccgcgcattataagagcccggcctttgacagcattatggcggaaacgctgaaagtgactgacgaggcgcagcgcacagctctgtacactaaagcagaacaacagctggataaggattcggccattgttcctgtttattactacgtgaatgcgcgtctggtgaaaccgtgggttggtggctataccggcaaagatccgctggataatacctatacccggaatatgtacattgtgaagcactaatggcaatacgtggggcaggagtgtcctgctccacggtgtctgatttttatcgcattacagaaggcacaggccagaaggtagggcaatgttaaaatttattctacgtcgctgtctggaagcgattccgacgctatttattcttattactatttcgttctttatgatgcgcctcgcgccgggaagcccttttaccggcgaacgtactttaccgccagaagtgatggccaatatcgaagcgaaatatcatcttaatgatccgatcatgacacagtatttcagctacctgaaacaactggcgcacggtgatttcggtccatcgtttaaatataaagattattcggtcaatgacttggttgcatccagttttcccgtttctgccaaactgggagccgcagcatttttccttgcggtaatactgggtgttagtgctggcgttattgccgcattaaaacaaaacaccaaatgggactataccgtgatggggctggcaatgaccggggttgttatccccagttttgtggttgcaccattattagtcatgatatttgcgatcattttgcattggctgccgggcggtggctggaatggtggggcgcttaaattcatgatattgccgatggtggcgttgtcactcgcttatatcgccagtattgcgcgtattacccgtggctctatgattgaagtattacactccaattttattcgtactgcccgggcgaaagggttacctatgcggcggatcattttacgtcacgcattaaaacctgctctgttacccgtgctctcttatatgggccccgcatttgtcggcattattaccggttctatggttatcgaaaccatttatggtttgccggggattggacaactgttcgttaatggcgcattgaaccgtgactattccttagtgttaagcctgaccatcctggttggtgctttaaccattttgtttaatgccattgtcgatgtgctatatgcggttatcgacccgaaaatccgttactgatactggagctcgcgatgatgttaagtaagaaaaacagcgagacgctggaaaatttcagtgaaaagctggaggtcgaagggcgcagcttgtggcaggacgcacgtcgacgttttatgcataaccgtgcggcggttgccagtctgatagtgctggtgctgatcgcgttatttgtaatcctggcaccgatgctttcccagtttgcctatgacgatactgactgggcgatgatgtccagcgccccggatatggagtccggtcactactttggtactgactcatccggtcgcgacctgcttgtgcgcgttgcgattggcgggcgtatctcactcatggtcggtgttgctgcggcactggtggctgtggtcgtcgggacactttatggttcgctttccggttatctgggcggtaaagtggattcggtaatgatgcgtctgctggaaatcctcaactccttcccattcatgttcttcgtcattttgctggtgacctttttcggtcaaaacatcctgctgattttcgtggcgataggcatggtttcctggctggatatggctcgtattgtgcgtgggcaaaccctgagtctgaagcgcaaagagtttattgaggcggcacaagttggcggtgtatcgacatcgggcattgttattcgccacattgtgccgaatgtactcggtgtggtggtggtctacgcatcacttctggtgcccagcatgatcctctttgaatctttccttagcttcctggggttgggtacgcaagagccgttaagcagctggggtgcattgctgagtgatggcgcgaactcgatggaagtctctccatggttattgttgttcccagcgggattcctcgtggtgacgctgttttgtttcaactttatcggcgatggcttgcgtgatgccctcgacccgaaagatcgttaaggagtgcagccatgagcgtaattgaaactgcaactgtgccgctcgcacaacaacaggctgacgcactgctgaacgtgaaagatttgcgtgtcacctttagtaccccggacggcgacgtcacggcggtcaatgatttgaatttttccctacgtgccggagaaacgctgggtattgtaggtgagtctggttcgggtaaatcgcaaactgcatttgcgttgatgggcctgttggctgccaacggacgtattggcggatcggcaaccttcaatgggcgtgaaatcctcaatttgccagagcatgaactcaataaactgcgcgctgaacaaatctcaatgatttttcaggacccaatgacttcgttgaatccctatatgcgcgtcggtgagcagttgatggaagtgctgatgctgcataagaacatgagcaaagctgaggcgtttgaagagtcggtgcggatgctcgatgcggtaaaaatgccggaagcgcgtaaacgcatgaaaatgtacccgcacgaattttctggcggcatgcgtcagcgagtcatgattgcgatggccttgttatgtcgacctaagctgctgattgcggatgaaccaacaactgcgctggacgtcaccgtacaggcgcagatcatgacgctattaaatgaactgaagcgggaatttaataccgccatcattatgatcacccacgatcttgtcgtggtggcggggatctgcgacaaagtgctggtaatgtacgccgggcgcacgatggaatatggcaacgcgcgcgatgtcttttatcaacccgttcatccttattctatcggtttgctcaacgcggtgccgcgtctcgatgcggaaggtgaaacaatgttgaccatcccgggtaatccgccaaacctgctgcgattaccgaaaggttgcccgttccagccacgttgtccgcatgcgatggaaatttgtagtagcgcaccgccgctggaagagtttacgcctggccgtctgcgtgcttgctttaaaccggtggaggaactgttatgaatgctgtaactgaaggaagaaaagtcctccttgaaatcgccgatcttaaagtgcactttgaaatcaaagatggcaaacagtggttctggcaaccgccgaaaacgctcaaagccgtcgatggtgtcactcttcgcctgtatgaaggggaaacattaggtgtggtaggggaatcgggatgcggtaagtccacctttgctcgcgccatcatcggtttggtcaaggcgaccgacggtcatgttgcctggttaggtaaagagttgctgggcatgaaacccgatgaatggcgtgccgttcgcagtgatattcagatgattttccaggatccgttggcatcgctaaacccgcgtatgaccatcggcgagatcatcgctgaaccactgcgtacttatcatccgaaaatgtcacgccaggaagttcgcgagcgcgtgaaggcgatgatgctgaaagtcgggttattgcctaacctgattaaccgctatccgcatgagttctctggtgggcagtgccagcgtatcgggattgcgcgtgctcttattcttgaaccgaagctgattatctgtgatgagccggtgtcggcgctggacgtgtcaattcaggcacaggtggtcaacctgctccagcaattgcaacgtgagatgggattgtcattaatttttatcgctcatgacctggccgtggtaaaacacatttccgatcgtgtgttggtgatgtatctcggccatgcggtagaactggggacctatgatgaggtctaccacaatccactacatccttacaccagggcattgatgtcggcagtccccatacctgatccggatctggagaagaacaaaaccatccagttactggaaggggaattaccgtcgccgatcaacccgccttccggttgtgttttccgtacccgttgcccgattgccggtccagagtgcgccaaaacacgtcctgttctggaggggagtttcagacactccgtttcttgcctgaaagtcgatccgctttaaaaacaataagggctgacagttgtcagccctttttcacgctaaaagcgattatttattcccgccagatgatatggcaaagtttgtgatctttttcgcggcataacagaatgcgggcaaaaacatcgttgatttcaccatcttcactgtccgccagaccaatcaccacttcggcaaaaaagtccgggttcaaatcgaaatcaacatgttcctgccagtcttccgccggatcgaataactccgcgccgccgcgctcttcaaactgaagattgaacagcagaacatcagctggatcgagattgtcggcagccagttcgagaaaaatatcgtaggcctgttcaagcgtttcatcttcagtcaggcgattgtttagatccatatccatagttactacctgtttaacctctgttggcgacgttttacagcaacggactgaagaagtaaaacagtcgctcggcgacacgttgccataatggacgttttagccataaacgggcatcgagcagacgtgaacgcgaaatataatcgtcctgaacggcggcgaggtcagcaccaaaacctttatcgtcgattgccagggtaatctcgaaatttagccacagactacgcatatcaaggttaactgtgccaaccagacttagttcgccatcgaccagcacgctcttggtatgcagtaacccgccttcaaactgataaattttaaccccagcagccagcagttccgtaaagaatgcgcgactggcccagccgaccagcatcgagtcattttttcgcggaaggataatactgacatccaccccgcgctgcgccgccgtgcaaatcgcatgaagtaaatcatcgcttggcacaaagtagggcgtggtcatgatcaaatattcacgcgccgaataagccgcagtcaataatgcctggtgaatgagatcttccggaaagccggggccagaagcaattgtgtgaatggtgtgaccgctggcctgttcaaacggcataatattgacatctggtggtggcggcagaatacgttttccggtttcaatctcccagtcgcaggaataaataatccccatcgcggtggcgatagggccttccatacgcgccatcagatcaatccattgccctacgcccgcatcttgtttgaagtagcgaggatcgaccatattcatgctgccggtgtacgcgatgtaattatcgatcatgatcatcttgcgatgttggcgcaggtccatacggcgtaaaaacacacgcatcagattgacctttaaggcttcgaccacttcaataccggcattacgcattagctcgggccacgggctgcggaaaaaagccacactcccggcggagtcgagcatcaatcggcaatgaatgccgcgtcgcgcagccgccattaatgattcagccacctggtccgccatgccgccgggctgccagatataaaacaccatctcaatattatggcgcgcgagctggatgtcgcggattaacgcctgcatcacatcatctgactcggtcatcagttgtagctgattccctttgaccccagcgatcccctgacgacgctcgcaaagcttgaataatggcgcagcgacactgctattttcttcggcgaagatatgcttacaggctttaaggtcgttaagccattttgcggtggaaggccacatcgctctggcgcgctcagcgcggcgtttgcctaaatggagctcgccaacggcaagataggcaataattccgactaacggcagaatgtaaataatcaacagccaggccatcgcggagggaactgcgcgtcgtttcattagaatgcgtaaagttacgcctgcaatgagcaaccagtatcccagaatggccaaccaactcaccaacgtataaacggttgtcatagattagaaatccttttgaaagcgcattgttatgagtttacgcatatggattcatctggcaaataaaaacgcgggaaaagcactggtcagcgtcgggggtgggggtataatgaccattctgttattgcatagagtagttaacatgaagcggagtagaacggaagtggggcgctggcgcatgcagcgtcaggctagccgacgtaaatcgcgttggcttgaggggcaatcgcgccgaaatatgcgtatccacagcatcaggaagtgcattctaaacaaacagcgtaactcgttattgtttgcgatctacaatatctaaatgtactgggcaccattgcggtgcccaataagtttactcttccgtctttaaactctatttttgcgccgattctttactgtcagctttcgtttctagttcatcgttatcgctgaaaataccatgacctgagttcaacaacattgaaacgagcatatcattattaatctcttcaccatttaaaactcgcgccagaatttcgctgccaaacagttgcggtgagagaatgatatccggatgtaccatcttaatcttattcaggtttttgctatcactgacggcgagaactgttttgacatcactgctcatatcttttgccgagagtacaacaaacgcgttatctgcatcgttatcactcagcgccagaatggcccggcaacgatcgattcccgctttctttaatacagaactgtcattactgtcaccggggataacatcagcattatcgcctaagcgttgctcaagttgcttgatatcatcttcaggcaagttgctgataaccgttacgttttgtccgcgttgattcagttgcaggatcgtattgatggcgagaatcgaatgtccgcaaacaataaaatgatctttacgatgcattgtatgattgtttccttttacaagtttgttgaatcccccgcggataagcggaccaaaaattgaggtcatagatgtggcaaaaacggtaatgccggaaataatgaccgaaatagtgaacaatcgtgctgattcagaaacagggacaatatcgccatagccgacggttgacatggtttctatcgaaaaatagaacgcggtcatcaaactttctattcgcggattaaaaccttcgcttaaataaagcgcaccgtaggttgagtaaaacagtaatgtcgtgaaactaataaatgcaaaaattgtcccggctgcggcgctactgtgggagaagtctttgcgcagtatcagcaaaaacaccagcgtaaaaatgcaaaatccaatactaaatttcagccagggataaaaatgcagggtgtaaattagcgctatcaacaacaaaatgatactgattgcccatgcgagctttgcccggaacagtaagccaatggagttcaggacaagaaagacgccgagcataaagagtggggcgtttgccagcaaggagagatccaactctgaaaatgctttgatatggaaaatatcaagcaaattgaccgacataccatagattgttttaaaaataagcaatccatttaaaaagacggccagcgcgagaatgtcgtgccgaagggtcacccataaatttgttgctgtttgtttgaatgtagcccagtgactcactgatacctctgtaaccacaattttgtttaattatcttagcgtgcacattttctgaacatacatgcagcgcgtgaatgtgttaaacaatagtagatgactttatccgcagtaatcaaaggatttgagcgagcaactgtacctcaggaaaggtcatttttcctgaatatgctcacatcatataaagaaatacagataaagttattatctgcttgtggtggtgaatgcactgaccggctataaggaaaggccaaacaagaacacggttgcaaaaaccgtgcccttaaatattgaatctctattcagaacactttcttaaatggtttcactgaaacgtgttcatagactcctgccgctacgtacgggtcagcatcggcccaggcctgagctgcttccagcgattcaaattcagcaataacggttgagccagtaaatcccgcagcccctggatcgttactgtctaccgctggcattggaccagctgtcaacaaacgaccttcatcatgcagtaactgtaaacgtgctaaatgtgccggacgaacggaaaggcgtttttcgaggctatcagctttgtcttgagcgtaaataacatacaacacgggcacaactccttgttcgggaaagttgtaaagtacgttatttgaaagggcgaagatctgcaacggaaagatgatgtctttgttaaggccatgcataaagtaagggtaattacgccaaaaatgacattttcactgatcctgatcgtcttgccttattgaatatgattgctatttgcatttaaaatcgagacctggtttttctactgaaatgattatgacttcaatgacccttgatttacctcgccgcttcccctggccgacgttactttcggtctgcattcatggtgctgttgtggcgggtctgctctatacctcggtacatcaggttattgaactacctgcgcctgcgcagccgatttctgtcacgatggttacgcctgctgatctcgaaccgccacaagccgttcagccgccaccggagccggtggtagagccagaaccggaacctgagccgatccccgaaccgccaaaagaagcaccggtggtcattgaaaagccgaagccgaaacctaagccaaaaccgaagccggtgaaaaaggtacaggagcagccaaaacgcgatgtcaaacccgtagagtcgcgtccggcatcaccgtttgaaaatacggcaccggcacgcctgacatcaagtacagcaacggctgcaaccagcaagccggttaccagtgtggcttcaggaccacgcgcattaagccgtaatcagccgcagtatccggcacgagcacaggcattgcgcattgaagggcaggttaaagttaaatttgacgttacgccggatggtcgcgtggataacgtacaaatcctctcagccaagcctgcgaacatgtttgagcgtgaggtgaaaaatgcgatgcgcagatggcgttatgagccgggtaagccaggcagtgggattgtggtgaatatcctgtttaaaattaacggcaccaccgaaattcagtaagcagaaagtcaaaagcctccgaccggaggcttttgactattactcaacaggtaaggcgcgaggttttccttcaggatcaaccgcgacatacttaaataatgcttctgtcgctttatagcgttgcccaattggttcagacgctacttttttcacccacacttcaatattaatgctgaccgatgtcgtccctttctggacacagcgtgcatagcagcacaccacatcgccgaccgcaaccggccgtaagaaagtcattccttcaacccgcacagtcactacgcgaccgtgggcaatttcttttgccagaatagcgccgccaatatccatttgtgacattaaccaaccaccaaagatgtcaccattggcattggtatcggcgggcatggctaaagtacgtaaaacaagatcgccctgagggacgttatgtgttgtagacatggtaaaaccgacttaaaaggaaaatcacaggcgcgatgctactatgattttcctgaggagaacagaggagatacagcgccagccccgaaggactggcagtctggttaggatttatcttcctgcggcatgtggcggtagatatagataccgcttaacaatgtgaagattaaggtaagggcggtcaggccaaagactttaaagttgacccaaatattttgcggcagccagaatgcgatgtagatgtttgccagaccgcaaaggataaagaaaacagcccaggccagattcagcttcgaccataccggttgcggcagcgtgagttctttacccagcatccgctgaattagcggctttttcatcacccattggctgactaacagggctcccgcaaatagagcataaatgacagtaaccttccatttaataaactcatcattgtggaagaacagcgtcaagccaccgaagacgaccaccagaacaaaagtgatcagggccatcttctcaaccttacgaaagcgaacccagctatagataagcacaatcgccgtggcgacgatcagcgccgcagtagccgcatagatgtcataaatcttgtaaaacgcgaaaaagacaaccagcggtaaaaaatcaagaaactgcttcattttacgattccgtaatcaaatgcttaaggttattggcgaatcaacatatacaggcggaacagatagatgagcaatatggctgaaatcaggttgctcaaggtgttcgccagtacggcaccaatttccggggttaatgcggcaaaagaagaggcaaaaagcagcaacagtgtttttgccagcaaccagctcagtactgcgggtgccaccagacgcatattcgcccaagtcagccgcatactgctacgcatcgaggcaaaaacgcccattttgtcctgtaccaacatcaccggtgccagggccagtaaaatggccatgataattcccggaacgaccaccagcatgatgccaatctgtactaaaagggtagtcagaaaaatcagaataaataactttggcaatatcggcgcactggcaccaatagctcgcagcgcactgactctctgacccgcagacaccagctggataattaatattacgcctccggcgagaatggcgttaccgattaatcctgaaaaagtggacgccgctgaagcctgcagcaaaatttgttgctgttccggtgacatattctgaaccaggtcgaacaacccactactgccgctaacgggcacgccgtcattgagctgcgcaagctgtgcatcactgggtgagaaaacatgccctaacaccactgtgataaacgcacatagcaacgataccaacagaatggtcataaattgattacggaagaaatttccggtgtcacggtatacggactgcgccgtgatagacatgcactctccttgagttttatgcaggtgttaattagcgggcaattgtaccctggttaagcctcgggtggcagcatcaggtcttgtatggaaaagcatatctttgtaaagcggaggtaattgctggccttcaggcatgggcaaatcgcggcaagtggcgaccgagttaatatttgcgtagcgaaaatatttaaaaattgatttaaatcacattaaccaggattctcaatgcaacttctaaattaatccagatcaataaagggtgaattatcatatgtaatgtgatctatgtaggatcatttgttactccaatgtaggtatattcgtcacgtttttataaccataacgacggagcggatatgaaaaagttaacagtggcggctttggcagtaacaactcttctctctggcagtgcctttgcgcatgaagcaggcgaattttttatgcgtgcaggttctgcaaccgtacgtccaacagaaggtgctggtggtacgttaggaagtctgggtggattcagcgtgaccaataacacgcaactgggccttacgtttacttatatggcgaccgacaacattggtgtggaattactggcagcgacgccgttccgccataaaatcggcacccgggcgaccggcgatattgcaaccgttcatcatctgccaccaacactgatggcgcagtggtattttggtgatgccagcagcaaattccgtccttacgttggggcaggtattaactacaccaccttctttgataatggatttaacgatcatggcaaagaggcagggctttccgatctcagtctgaaagattcctggggagctgccgggcaggtgggggttgattatctgattaaccgtgactggttggttaacatgtcagtgtggtacatggatatcgataccaccgccaattataagctgggcggtgcacagcaacacgatagcgtacgcctcgatccgtgggtgtttatgttctcagcaggatatcgtttttaattccgcacaaaaacgaccccgtaatatacggggtcaataaggacatggtataaagggtattatttcttcgcttctacgccatcagtttcagagcgaattaaaaatttctcagttgtttgcggaatattctgaatcagccagtcggccatttgcttttcctcatttaaaatcgcttcgatggttggaattgaagctgtatcaccggcattttttgctgctgctaatagtgaggtgtaacaggcgatttcaaattgctcgaagacatatccgctaatagagcctttgactatttcatcagaagggaatataccaccgattgactgcccaagcgcagccattttactcatggaatctttaatgactgaacgtgaaatgtcattacgatcaagaatagtttccagttgaacaatctggtttttggtttcactaagatgttgttcaatacgagcgcgtagttcaggataattatctatacggctggccatggattcaagcatagattcggcttgcttttccattgcgtgggcgtcacgtaaccagtcatgataatgttcaatacgattcatgaaaatgtcctctttataaaatgactaaaagttaaaattcatatttcaggctttattttcggctttcttatttacgttattaatggccagatcagtcagtttgatgtcggtggccttttcttcttccagggtttctttcagaagcttcgctgctttacggtaacctaattgttcagccagcgtcgctaatgtcccgtaactggcaatctcataatgctcgactttctgtgctgcggcaatcagtgcggcatcacgcacttcgtttttctcggtactttcgatgacctcattagcttcttcaataagaccttccattgccacacatttcatgcgcttaattttcaggttcgattcggactccacaacttgatcaatacgttcaatctgtccatgagtttcctcgaggtgcgcatgaaaagcctgacttaatttttcatttgatgttgctcttgcgagttttgccagtgcccgggttaattgtttttctgcgctgtaggtatctgaaagcaggtgaataaatacatcttcaatggtcttcatattcatatttttctccagtgaaatcactgcgagccatacggcccgcagatgcaattatctttatcagctgatattaataattaacggtgaatcaggatttgcctgatttattaccaccgctttgttgaccgccttttttacccgcttcagatgcgcgttgcggatcatttttaaaattaccgccgctatgctgaccgcctttacggcctgcgtcggatgccttctcacggtcttcggcgaaatttcctgaaccaccacgatgttcggccatgttatttctcccgttgcgttgcattgtttcattaatatgagtgttgtgtgtcgacactcattaaaattagtcgctaatgagaattagtcaaattaagcgcaacgagaagatagagggaaaatatattttgaggaacattctggatatattaacaattacctgaggaataagtgacttagagaaaattattgattttactggtgttatgttgcgggattaatttgtttgattatattactgttgggcggaaaaatgacgtaagttgacgttcgaccggggtaagcgaaacggtaaaaagataaatattaaatgaatttaggatttttccggcttcattaaagaaagttaaaatgccgccagcggaactggcggctgtgggattaactgcgcgtcgccgctttcatcggttgtacaaaaactttcagtgccgccagcattttctctggctcattaatatgttgctcgatgattttaacaatggccgaaccagaaatcgcgcccgcagctcctgcatcaatcgctgcttttacctgatccggggcggaaataccaaatccctgcaatggaggtgcagcgttgtactctttcagcttcgcaaccagatgattgaggggtaacgcggcgcggttttctgcgccggtcacgcctgctcgtgacagcaaataggtgtaaccacgaccgtaagaggctatctggcgcagcaggtcgtcatcggcatttggcgggcagatgaagataggtgcgacattatgacgcaacgcggcctggcggaagggcgcggactcttcaactggcacatcggcaaccagcaccgaatcgacgccgactttttcgcactgggcataaaactcatcaatgcctttgttaaacaccagattggcatacatcaacaggccaatgggaatggtcgggtgtttctggcgaatcagtgccagcatttcaaaacattgtgccggagtcacacctgccgcaaaggcgcgcagagtggcgttttgaatcgtcgggccatccgccagtgggtcggagaaggggatacctaactccagcgcgtcagcaccggcttcaattagcgtatcgataattttcaatgactgctcaatgcccggatcaccgagcgtgacgaaaggaacgaatgcgccttctttgcgctccttcaactgggcaaacagagattcgtagcgttccatcagatttcccctcgtgctttcaaaatatcgtgaacggtgaagatgtctttatcgccgcgaccggaaaggttaaccaccagtagctgctctttatccgggttttcgcgcatcattttcaacgcatgggccagggcgtgggaggattccagcgccgggatgatcccttcgtgcaggcacagcgttttgaaggcttcaagggcttcatcatcggtaatagacacgtaatcagcgcgtccagtgctgttaagatacgcgtgttgtgggccgacagacgggaaatccagtccggcggagatggagtaagattcttcaatctgcccgtcttcggtttgcatcatcggcgctttcataccgaaatagatacccacgcgaccatgttttagcggtgcgccgtgctcgccagtttcgataccgtgaccacctggctccacaccaatcaggccgacgttggtttcattgatgaaatcagcaaacatgccgatggcattcgaaccgccgccaacacaggcgataacggcatccggcaggcgaccttctctttccagaatctgcgctttggtttcttcgccaatcatccgctgaaactcacgcacaatggtcggataaggatgcgggccagctgcggtgcccagcatatagtgcgcggtttcgtaactaccggaccagtcgcgcagcgcctcgttacaggcatctttcagcgtcgcggaaccgctatgcaccgggatcacttccgcacccattaagcgcatacgaaaaacgttaggcgactggcgttcaacgtctttggcacccatataaatacggcatttcaggccgagcagggcgctggcaagggccgacgccacgccatgctgaccggcaccggtttcggcgatgatttcggttttacccatccgcttcgccagcaacgcctgccccagcacctggttagttttatgcgcgccgccgtgcagcaaatcttcacgcttgagatacagcgtggtgttcgtcccggctgtaatgttctggcatttggtcagcgcggttggacgcccggcatagtttttcagcaggtcgttgaactgagcctgaaattcaggatctttttgcgcactgacaaaagcttcttccagctggcgcagagcaggcatcaggatttgtggcacgtacatgccgccaaactcaccaaaataggggttaagtaatgttgtcattgttcctttccttaatatgcgcgcagcgtctggaaaaccgaggccaaaagacgtgcgtctttgatgcccggttgcgactctacagcagaattaaaatcaagtccggcgcagccggtttgtgccgcttccacgcagttatctgcgcctaagccccccgccagcagaacgttgccaagcgattgaccatttaatagtgaccagtcaaaacgttgcccgcttccaccctggccgttgtctaaaacatatttatcaacgtgctgaaactcgcgggcgggcagggtttcaccgacgcttaatgctttccagatggcaacatgtgctggcagagcttcacgcagcgtatcgatatacagctgttcttcattaccatgcagttgcactgccgccagcgataacaccttagctttgtccaccacatcggcaatatcgtgattgcggaacacgccaacatactgcaacggtgccgcagccatcacttcctgcgcctgttcaacgttgacgcaacgcggtgatgtcgcaacaaaaatcaacccaccgtaaatcgcgcccgcgtcataagctgctttagcatcttgcccacgcgtcaggccacatactttattctcacccagcaacacccggcgcacggcggcgtgcaaatcgtcatgggccatcaacgccgaaccaatcagaaaaccgttagcgaagtggcttaactcgcgcacctgagcgtaagtattgatgccggattcgctgattaccgtcacgttgtgccccagtttcggcgcaagctcgcgggtacggttgagatcaatcgacaaatcacgcagatcgcggttgttgatgccaacgacctttgctcccaatgcaatggcgcgctcctgttcctcttcattactgacttcggtcagcacccccatctccagactgtgagcgacggcggcaagctggcgatattggtcgtcatccagtactgaaagcattaataagcaggcatcggcctggtaatagcgcgccagatagatctggtaagggtcgataatgaagtctttacataaaatcggctgcggggcgatttggctgacgatggggaggaaattaaagctcccctgaaaatatttctcatcagtcagcaccgaaattgccgaagcgtaatgtttataaatggcggcaatgcgtgctggatcgaaatcatcacggatcacgccttttgacggcgacgctttcttgcactccagaataaacgccgtgcgcgcaccctgtagcgcatcataaaaatgtcgcgtgctcggctgaacctcattctgaaaactggccagcggttgctgctgtttgcgggcttctacccaaatcgccttgtctgcgacgattttcgctaaaacggtttgcatcatttaccctcgtgccgccagtgcggtgactctgtcgtaagcggaaccactgcgcagtacctcaagaacggtttgcgcattggcttgcagatcttcatggccatgcaggcgcattaacatggcgacgttcgcagcgacggctgcttcatgggcggcgtcgcctttaccttgtaacaaacgtgttaaaatgtcacggttttcttccggtgttccgcctgccagttgctcctggtggtagggtgtcaggccaaagtcttctgcggtgagctgatagcttttaatttcgccgtcatgcagttcggcaacgattgtcggcgcgtgtaatgaaacttcatccatcccgccgctgtgcaccaccgccgcgcgttgataccccagcacgcgcaaggtttcggcaatcggcagcaccagttccggactataaacaccaattaacgccagcggcggatgcgccgggttaatcaatggccccagcacattgaacagggtgcgggttttcagttgctggcgaaccggcatcgcgtggcggaatccggtgtgatacttcggcgcaaagaggaaacatacacctaactcatccagcgcctggcgcgatttatcggcgttcatatcaagattaataccgaacgccgccagcagatcggacgaaccagatttactggagacgctacggttgccgtgtttcgccactttcagcccacaggccgcggcgacaaacgcactggcggtagaaatattgatactgttgctgccgtcaccgccagtaccgacgatatcagcaaacagataatccgggcgcgggaacggcgctgcgttttccagtagcgcggttgctgccccggcgatctcgttcgggtgctcaccgcgaattttcatgctcaccagcgccgccgccagttgttccggcttcagctcgccacgcaccaccgctgaaaacagctggtggctttcttgttggctaagcgtctgcgcctgatacagtttttccagaatcggttgcagcgtgttggctggctctagtttctgctgcgcccaggccagcgtttgttccagcaggcgagcgccctgggtggtgagaatggattccggatggaactggaatccacaaacgcgatccgcatcgtgacgtactgccatcaccatgccattaaaatgggcgttgatggttaaaccggccggaatgttactgccaaccagcgagtgataacgcgccaccggcagcgggtttgttaatccggcaaacatcgcctgaccgtcatgttcaatgctggaggctttaccgtggagaatttcgcccgcctgaccgacatagcccccgtaagcttcgacaatcgcctgatgtccgaggcaaatgccaataatgggcagcttgccacgcaagcgggtgaggagttccggcatacaaccggcttcgctcggcacaccggggccaggagaaagcatcagcaccggattgctcatggtcgccaggcgttcaattaaggtttgcgccggaatatggttgcggtaaatcaccacgttatgcccattgctgcgcaactgatctgccaggttgtacgtaaaagagtcgatattatcgagcagcagaatgtcagccatcagaaagtctcctgtgcatgatgcgcggtggcaatagcgcgcagtacagcgcgggctttgttacgggtttcgtcggcttccgactgcggaacagaatcaaggactacaccagcacccgcttgcacggtggcgataccgttttccaccagcgccgagcggatcacaatgcaggtgtcgagatcgccatgcgcggtgaaataacctaccgcgccgccgtagctgccgcggcgacgaccttccgcctcggcaattaactgcatagcgcgtactttcggcgcaccgcttaacgtccccatattcatacaggcgcgataagcgtgcagggcgtcaagatcgtgacgcagttcgccgactacgcgagagacgaggtgcatcacataggaataacggtcaactttggtgagatcggcgacgtagcggctgccgggggtgcaaatgcgtgccagatcattacgggcgagatcaaccagcatcagatgttcagacagctctttatgatcggtacgcatttccagttcaatacggctgtcgagatctctgtccagtgaaccatcggcgcgacgaccgcgtgggcgtgttccggcaatcgggtagatctcaatctggcggctggtggcatcatacttgagcgagctttccggcgacgcgccaaatagggtgaaatcattatcctgcataaaaaacatgtacgggctgggattactctttttcagcacgtaataggccgccagcggtgacgggcagggcagagagaaacggcgagatggcaccacctggaaaatttctccagcgcgaatcgctttttgcaacaaacgcactacgccaccgaactcttcatcgctctgattacattcacaacgcatatgcggcacggaaaccactggcagcggcggcgcggcttcggtcagttgctgacgtagttcgttcaggcgagcagtgagacgttgtttttcttcttcattcggagcaaacaggctggcctgaatacgggtgctttttttctgatggtcaatcaccatcagcgtttcagcgagataaaaacagaaatcagggcagttattttccgctgacagttgcggtaaatcttcaaatcccgccacaaggtcataagagaacaggccgccgaagaacatggcttctcgttcttccttcggtacattcaacagattctgcaataaacggaaagcgtcaaaaaccgaaagggagcataagcgggcgtcttcatccagcagtggactgacaggggggaagcgcagcacacggcagtttggtgattgttcactttccacacccgcaggcagggcgttatccagtagtgccaggagggcttcgccgttgccggaaagtgcctggattgtgacagtgtcacctaaagctgtaatgcgcagcgcactgtctaccagcagcaggctttttaaatcatctttgctgtcgatatctgcggattccagcagcagcgttgccggacgatccccacacaactggtgaaaaagcgcggtgggattgtcgcgataagcgccttcgcaggttagcagttcgagagtcggtttttgtgtttgcattgttattctctaattttgttcaaaaaaaagcccgctcattaggcgggctgggtatctgattgctttacgcatggtgaatacactgcccgtttcaggaagtgcgccaccaacctttcagtacgaaaattgctttcattgtcgataccctttttacgtgaacttgcgtactagttaactagttcgatgattaattgtcaacagctcatttcagaatatttgccagaaccgttatgatgtcggcgcaaaaaacattatccagaacgggagtgcgccttgagcgacacgaattatgcagtgatttacgacctgcacagccataccacagcttccgatggctgcctgacgccagaagcattggtgcaccgtgcagtcgagatgcgcgtcggcaccctggcgatcaccgaccatgacaccacagctgcaatcgcgccagcaagagaggaaatttcacgttcgggactggcgttgaatcttattcccggcgtggaaatttccacggtctgggaaaatcatgaaattcatattgtcgggctgaatattgatattactcatccgctaatgtgtgagttcctcgcgcagcagacagaacggcgcaatcagcgggcgcagctgattgccgaaagacttgaaaaagcgcaaatacctggggcgctggaaggcgcacaacgactggcgcagggcggcgcagtgacgcgcggtcattttgcgcgtttccttgttgagtgcggcaaagccagttcaatggcggatgtctttaaaaagtatctggcgcgcgggaaaaccggatacgttccgccacagtggtgtacaatagaacaagctattgatgtcattcatcattctggcggtaaggcggtgctagctcatcctgggcggtacaatcttagtgctaaatggctgaaaagattggttgcgcattttgccgaacaccacggtgacgcgatggaagtcgcgcagtgccagcaatcgcccaatgaacgtacccagctggcggcccttgcgcgtcagcatcatttatgggcatcacaaggatctgattttcatcagccatgcccgtggatcgaactgggtcgtaaactctggctgcccgcaggcgttgaaggcgtctggcagctatgggaacagccgcagaacaccacagagagggaattatgagccagtttttttatattcatcctgataacccacagcaacgtctgatcaaccaggcggtggagatcgtgcgtaaaggcggggtgattgtttatccaactgattccggctatgcgctcggctgtaaaattgaagataaaaacgcgatggagcgtatttgtcgtattcgccagctgccggacggtcacaactttaccctgatgtgtcgcgatctttctgaactctcgacctattcatttgttgataacgttgcgtttcgtttaatgaaaaacaacacgccgggcaactataccttcatcctgaaggggacgaaggaagtgccacgccgtctgttgcaggaaaaacgcaaaaccatcggtatgcgtgtgccttctaaccctatcgctcaggcgttacttgaagcattgggcgaaccgatgctttccacttcgctaatgctgccaggcagcgaatttaccgaatcggacccggaagaaattaaagatcgtctggaaaaacaggtagatttgattattcacggcggctatctcgggcagaaaccgacaacggttattgatcttaccgatgatacgccggtcgtggtgcgtgaaggcgtaggtgatgtgaagcctttcttataacaaattgcgttccacggatggaagactatggcagggaagtttcgctgcattttgctgttgatagcagggctgtttgtatcatctctaagttatgcagaaaacacggagatcccttcttatgaagaagggatctcgctctttgatgttgaagccactctgcaaccagatggggtgctcgacatcaaagaaaatattcattttcaggcgcgaaatcagcagattaagcacggcttttatcgtgatttaccacgactatggatgcagcctgatggggacgctgcactgctgaactatcatattgttggcgtcacccgtgatggtattcctgaaccctggcatcttgactggcatatcgggttaatgagtattgtcgtgggcgataaacaacgtttcttgcctcaaggcgactatcattatcaaattcattatcaggttaaaaatgctttcctgcgtgagggggattctgatctgctaatctggaacgtgaccggtaaccactggccgtttgaaatttataagacccgtttttctctccagttctctaatattgcgggtaatccatttagcgaaatcgatctttttaccggagaagagggcgacacatatcgtaatggccgcatccttgaggacggaagaattgaatcccgcgatccgttttatcgtgaagatttcacggtcctctaccgctggcctcacgctttacttagcaatgcctcggctccgcaaacgacgaatattttcagccatcttcttttaccctccacgtcatcgttgttaatttggtttccgtgtctgttcctggtttgtggatggttatatctctggaagcgcaggccgcaatttacgccggtagatgtgattgaaaccgatgtcattccgccagattacacgcccggcatgttacgtctcgatgcgaagctagtttacgacgataaaggtttttgtgccgatatcgtaaatctgattgtgaaaggaaaaattcatctggaagatcagtctgacaagaaccagcaaatcctgattcgtgttaatgaaggcgcgaccagaaataatgcggtattactgcccgcagagcagttattactggaagcgttatttcgtaaaggcgataaggtcgttcttacggggagacgcaacagagtcttacgcagggcatttttacggatgcagaaattttatctgccgcgtaaaaagtcttcgttttaccggtctgatacttttttgcaatggggtggactggcaatattggcggtcattctttacggtaacttgagtcctgtaggctgggcaggaatgagtctggtgggcgatatgtttattatgatctgctggattattccttttttattttgttcccttgagcttttgtttgcccgcgatgatgacaagccttgcgttaatcgtgtaatcatcactttgtttttaccactgatttgttcaggcgtggccttctattctctctacatcaatgtcggagatgtattcttttactggtatatgccagcgggttattttaccgctgtttgcctgaccggttatctcactggcatggggtatatttttctgccaaagtttacccaaactggacagcaacgttatgcccacggtgaagctatcgttaactatcttgcgcgtaaagaggcagcaacacacagtggacgtcggcggaaaggggaaacacggaaactggattacgcgttgctaggttgggctatatcggcaaatttggggagggaatgggcgttacgcattgccccttcgctttcttcggcgattcgcgctccagagattgcccgtaacggcgttttattctcattacagacgcacctaagttgcggggccaataccagtttgttggggcgaagttattccggtggtggtgctggcggcggcgcgggtggcggaggcggtggtggctggtaattaagctgatgttaatcgaaacaagctttaaccataaagatagtgtagtatgttgcgcctcaaagccaggccgataaacgtcgagtcgtttacttaaggcctgaagagttcaaacagactttactatcagtgagtcagatgtaagttctgactcactgttgcacaaaagcatatcagacgcctgggaaggcgacaccaaaaggaagctctatgagcgaaaagctacagaaagtgctggcgcgtgccggccacggttctcgccgtgaaatcgaatctattattgaagccggtcgtgtgagtgttgatggcaaaattgctaaactcggcgatcgtgttgaagttacccctggattgaaaatccgtatcgatggtcacctgatttcggtacgtgagtccgctgaacaaatttgtcgcgttctggcctattacaaaccggaaggtgagttgtgtacccgtaacgatccggaaggacgtccaacggtgtttgaccgtctgccaaaactgcgtggcgcacgctggattgccgtgggtcgcttggacgttaatacctgtggtctgctgctgttcaccaccgatggtgaactggcaaaccgtttaatgcacccaagccgtgaagttgaacgtgaatatgccgtgcgtgtatttggtcaggttgacgacgcgaaactgcgtgatttgagtcgtggcgtgcagttggaagatggtccggcagcttttaaaaccatcaagttcagcggcggcgaagggatcaaccagtggtacaacgtgactctgaccgaaggccgtaaccgtgaagttcgtcgtctgtgggaagcggttggtgtgcaggtgagccgcctgatccgtgttcgttacggtgatatcccactgccaaaaggtctgccacgcggtggctggacggagctggacctcgcccagactaactatctgcgcgaactggtggagctaccgccagaaaccagctctaaagtcgctgtagaaaaagaccgtcgtcgcatgaaggcgaatcagattcgtcgtgcggtgaaacgtcacagtcaggtgagcggcggtcgtcgttctggcggacgtaataataacggttaatcaaagtatgccggacgtcatatccggcatttttacagattaataatcgatccctatctgcgcttttacaccggcatcaaacgcatgtttgacggggcgtaattcacttaccgtatctgccagttcaagaatatcccgatgacaaccacgacccgtgataatcaccgtctgttgatgtggacgttcatttaacgcctgcaccacttcttccagtggcaaatagtcatacgccaccatatacgtcagttcatcaagcaaaaccatatccagtgaggaatcagcaagcatccgctttgcatgttgccagacttcgcggcaggcggcggtatcagactcgcggttttgtgtatcccaggtaaagcccgttgccatcacctgaaactcaacgccatgtggctccagcagattgcgttcgccattaggccaggtgcctttaataaactgcacgacgcctactttttttccgtgaccaactgcgcgtgttgccgtaccaaatgccgcggtggttttgccttttccattgccggtaaagacgatgataataccgcgttcatcctgggcctgggccacacgagcatctactttttctttcactcgctgctgacgctgttggtagcgttcatcactcattgggaaattcctggtttacggcccggttgggcgtcaaaggtcatgccggttttacggcggctgtcatcgcccatcagccagaggtagagcggcatgatatcagcgggtgttttaagtttctgtggatcttcggtcgggaaggcgctggcacgcattgcggtgcgcgtaccgcctgggttaatgcagttgacacgcaggcgctgctgatattcatcggccagtacctgcatcatcccttcggtggcaaatttcgacgctgcatatgcaccccagttggctcgtccctgacgtccaacgcttgatgaagtaaagaccagtgaaccggcgtccgatttgagtaataaaggaagcagtgcctgggtgagcataaaggtggcattaacgttgacctgcatgacgtcctgccagacctgcggattttgttcgctcattgggcaaacatcgccgagcaatccggcattatgcaaaacaccatccagacgcggataattaacggcaatgcgctgtgccagttgttggcaattttcggacgtgcaggtcagcaaatcgagaataaaccactgtggctgacgcccagtttcttcgtttatgtggctggctacctgacgtaatttttcttcattacggcccaacagaatcactgtcgcaccatagcgtgcatacgtcatcgcggcttcacgaccaataccatcgctggctcccgtcaccaggataatgcgatcattgagtaaatcttgttttggctggtaatgcatggctactcctcaacgacgttgtctgtcgcgctgccagtgtactttatgactttggggctttatgcctgaaacagaagggcatttcaatcagcctggggcgataacaccgcaaaatggatactttgtcatactttcgctgcaataacatctctgcgagacggcttaacatgcctgttgtaaactgtgagccaaagcgttgtttaaccaaggtggggactcgtggaattgttgtctgaatatggtttgtttttggcgaaaatcgttaccgttgtgctagcgattgcggcgattgccgccattattgtcaatgttgctcaacgtaataaacgccagcgtggcgagttacgggtcaacaatctcagcgaacagtataaggagatgaaagaagaactggccgcggcgctgatggactcacatcagcaaaaacagtggcacaaagcgcagaagaaaaagcataagcaagaagcgaaagcagcaaaagcgaaagccaaactgggcgaggtggcaactgacagtaaaccccgcgtctgggtgctggattttaaaggcagcatggacgcccatgaagtgaactcgctacgtgaagagataacggctgtactcgcagcattcaaaccgcaggatcaggttgtgctccgtctggaaagccctggtggcatggtgcatggttacgggctggcggcttcgcaactgcagcgtctgcgcgataaaaacattcctttaactgttacggtagacaaagtcgctgccagcggcggttacatgatggcctgtgtggcggacaaaattgtttccgcaccgtttgctattgtgggttccattggcgtggtggcgcaaatgcccaactttaaccgcttcctgaaaagcaaagatattgatatcgaactgcacactgccgggcagtataagcgcacgctgacgttgctgggtgaaaataccgaagaagggcgggagaaattccgcgaagagttgaacgaaacgcatcagttgtttaaagattttgtgaagcgtatgcgtccttctctggatattgaacaggtggcaacgggtgaacactggtacggacaacaggcggtagagaaaggcctggttgatgaaatcaacaccagtgatgaagttattcttagcctgatggaaggccgtgaagtggtcaatgtacgctatatgcagcgtaaacgactcattgaccgattcaccggcagcgcggcagagagcgccgatcgattgttgctacgctggtggcagcggggtcaaaagccattgatgtaaaagacaaacgcgaggctaagacctcgcgttttgctttaatcaaccagatgatatttttctgaaagcacatgggccaggtgtttgaacatattaaacaccgcggtgcttttggctgttggcaatccttgttcatctaaaaagtagtcgccggtaaataccagcacgccattacgctgcgtgacgccggtggcttcaatccctgcgagcgtatcctcatgctcacgaatgattttgttggcctctttcaacagcgtttcgcggtcgatgggttgtgtctctttgttcattatttactccttaaacaaggacattagtctacgccaggcatggcttgcagacaaatataccacgctggtggcaagagcgccttactggcaactttggattttgcatgctaataaagttgcgtatcggattttatcaggtacagtgtgacgctttcgtcaatctggcaatagatttgcttgacattcgaccaaaattccgtcgtgctatagcgcctgtaggccaagacctgttaactcagtcacctgaattttcgtgaacagagtcacgacaaggggttgatatccgcagagagcgagtccatatcggtaactcgttgccagtggaaggtttatcaacgtgcgacgcattcctggaagaatcaaattaggtaaggtgaatatgggtaaagctcttgtcatcgttgagtccccggcaaaagccaaaacgatcaacaagtatctgggtagtgactacgtggtgaaatccagcgtcggtcacatccgcgatttgccgaccagtggctcagctgccaaaaagagtgccgactctacctccaccaagacggctaaaaagcctaaaaaggatgaacgtggcgctctcgtcaaccgtatgggggttgacccgtggcacaattgggaggcgcactatgaagtgttgcctggtaaagagaaggtcgtctctgaactgaaacaactggctgaaaaagccgaccacatctatctcgcaaccgaccttgaccgcgaaggggaagccattgcatggcacctgcgggaagtgattgggggtgatgatgcgcgctatagccgagtggtgtttaacgaaattactaaaaacgcgatccgccaggcatttaacaaaccgggtgagctgaatattgatcgtgttaatgcccagcaggcgcgtcgctttatggaccgcgtggtggggtatatggtttcgccgctgctatggaaaaagatcgctcgtggcctgtctgccggtcgtgtgcagtcggtggcggttcgcctggtggtcgagcgtgagcgtgaaattaaagcgttcgtgccggaagagttctgggaagtcgatgccagcacgaccacgccatctggtgaagcgttggcgttacaggtgactcatcagaacgacaaaccgttccgtccggtcaacaaagaacaaactcaggctgcggtaagtctgctggaaaaagcgcgctacagcgtgctggaacgtgaagacaaaccgacaaccagtaaacctggcgctccttttattacctctacgctgcaacaagctgccagcacccgtcttggatttggcgtgaaaaaaaccatgatgatggcgcagcgtttgtatgaagcaggctatatcacttacatgcgtaccgactccactaacctgagtcaggacgcggtaaatatggttcgcggttatatcagcgataattttggtaagaaatatctgccggaaagtccgaatcagtacgccagcaaagaaaactcacaggaagcgcacgaagcgattcgtccttctgacgtcaatgtgatggcggaatcgctgaaggatatggaagcagatgcgcagaaactgtaccagttaatctggcgtcagttcgttgcctgccagatgaccccagcgaaatatgactccacgacgctgaccgttggtgcgggcgatttccgcctgaaagcacgcggtcgtattttgcgttttgatggctggacaaaagtgatgcctgcgttgcgtaaaggcgatgaagatcgcatcttaccagcagttaataaaggcgatgctctgacgctcgttgaacttacaccagcccagcactttaccaagccgccagcccgtttcagtgaagcatcgctggttaaagagctggaaaaacgcggtatcggtcgtccgtctacctatgcgtcgatcatttcgaccattcaggatcgtggctacgtgcgagtagaaaatcgtcgtttctatgcggaaaaaatgggcgaaatcgtcaccgatcgccttgaagaaaatttccgcgagttaatgaactacgactttaccgcgcagatggaaaacagcctcgaccaggtggcaaatcacgaagcagagtggaaagctgtactggatcacttcttctcggatttcacccagcagttagataaagctgaaaaagatccggaagagggtggtatgcgcccgaaccagatggttctgaccagcattgactgcccgacttgtggtcgcaaaatggggattcgcacagcgagcaccggggtattccttggctgttctggctatgcgctgccgccgaaagagcgttgcaaaaccaccattaacctggtgccggaaaacgaagtgctgaacgtgctggaaggcgaagatgctgaaaccaacgcgctgcgcgcaaaacgtcgttgcccgaaatgcggcacggcgatggacagctatctcatcgatccgaaacgtaagttgcatgtctgtggtaataacccaacctgcgacggttacgagatcgaagagggcgaattccgcattaaaggttatgacggcccgatcgttgagtgtgaaaaatgtggctctgaaatgcacctgaaaatggggcgtttcggtaaatacatggcctgcaccaacgaagagtgtaaaaacacacgtaagattttacgtaacggcgaagtggcaccaccgaaagaagatccggtgccattacctgagctgccgtgcgaaaaatcagatgcttatttcgtgctgcgtgacggtgctgccggtgtgttcctggctgccaacactttcccgaaatcgcgtgaaacgcgtgcgccactggtggaagagctttatcgcttccgcgaccgtctgccggaaaaactgcgttatctggccgatgcgccacagcaggatccggaaggtaataagaccatggttcgctttagccgtaaaaccaaacagcaatatgtctcttcggaaaaagacggaaaggcgactggctggtcagcattttatgttgatggcaaatgggttgaaggaaaaaaataacctttaattctgtcaggtttttataaacaaagggtcgcgaaagcggcccttttttattgcatattattttttcttcacacctatacactaaggctataaatgatatagtggttatagttagcaccttttttattattaaatcgtattagtcacccgccaggtgtgacgaaaaaacgatgttctgatggcgtctaagtggatggtttaacatgaaattacaacaacttcgctatattgttgaggtggtcaatcataacctgaatgtctcatcaacagcggaaggactttacacatcacaacccgggatcagtaaacaagtcagaatgctggaagacgagctaggcattcaaattttttcccgaagcggcaagcacctgacgcaggtaacgccagcagggcaagaaataattcgtatcgctcgcgaagtcctgtcgaaagtcgatgccataaaatcggttgccggagagcacacctggccggataaaggttcactgtatatcgccaccacgcatacccaggcacgctacgcattaccaaacgtcatcaaaggctttattgagcgttatcctcgcgtttctttgcatatgcaccagggctcgccgacacaaattgctgatgccgtctctaaaggcaatgctgatttcgctatcgccacagaagcgctgcatctgtatgaagatttagtgatgttaccgtgctaccactggaatcgggctattgtagtcactccggatcacccgctggcaggcaaaaaagccattaccattgaagaactggcgcaatatccgttggtgacatataccttcggctttaccggacgttcagaactggatactgcctttaatcgcgcagggttaacgccgcgtatcgttttcacggcaacggatgctgacgtcattaaaacttacgtccggttagggctgggggtaggggtcattgccagcatggcggtggatccggtcgccgatcccgaccttgtgcgtgttgatgctcacgatatcttcagccacagtacaaccaaaattggttttcgccgtagtactttcttgcgcagttatatgtatgatttcattcagcgttttgcaccgcatttaacgcgtgatgtcgttgatgcggctgtcgcattgcgctctaatgaagaaattgaggtcatgtttaaagatataaaactgccggaaaaataatttcttgcgttattttcggcaccttttatgtagcgaaggtgccggaatatattctcttttgttacttatttctataccgtgcacaatatttttatccctcatatttatagggtaaattacctgtaaagtagtgtctaattacccgcctcgcaaactccagttttcaaatatctatttcaggtcaaaagattgaattattcactggagacgattcgtaaattcgctggatttttgactaaagtttctttaggatttgtctcatcgtatgattaattacaccaatcgttcaacgtcttgctgataagtgatggcgattatatgaggttagcaatgccttctggaaatcaggaaccccgccgcgatcctgaattaaaacgtaaagcctggctggcggtttttcttggttctgcacttttctgggtggttgtcgcactgctgatttggaaagtgtggggataactatggtcggtcaggagcaactggagtcgtcaccattatgccagcatagtgacaatgaaacagaaacgaaacgggaatgttccgtcgttattccagacgactggcaactaacatcgcagcagcaagcctttatagaactgtttgctgaagatgatcagccgaaacaataattatcatcattcttattacccatttttaatgaattaaagggcttttaatacaccgcagcaataacagcttgagttatctcaacacaaaataataaccgttaagggtgtagcctatgatcaacacaaatatgaaatattggtcctggatgggcgcgttttctctgtcgatgctcttctgggccgaactcctctggatcattactcactgatccttgaccccgctgcggcggggttgtcatttgctttgccacaaggtttctcctcttttatcaatttgggttgttatcaaatcgttacgcgatgtttgtgttatctttaatattcaccctgaagagaatcagggcttcgcaaccctgtcattaaggaggagctatgtcgtcaaccctacgagaagccagtaaggacacgttgcaggccaaagataaaacttaccactactacagcctgccgcttgctgctaaatcactgggcgatatcacccgtctacccaagtcactcaaagttttgctcgaaaacctgctgcgctggcaggatggtaactcggttaccgaagaggatatccacgcgctggcaggatggctgaaaaatgcccatgctgaccgtgaaattgcctaccgcccggcaagggtgctgatgcaggactttaccggcgtacctgccgttgttgatctggcggcaatgcgcgaagcggttaaacgcctcggcggcgatactgcaaaggttaacccgctctcaccggtcgacctggtcattgaccactcggtgaccgtcgatcgttttggtgatgatgaggcatttgaagaaaacgtacgcctggaaatggagcgcaaccacgaacgttatgtgttcctgaaatggggaaagcaagcgttcagtcggtttagcgtcgtgccgccaggcacaggcatttgccatcaggttaacctcgaatatctcggcaaagcagtgtggagtgaattgcaggacggtgaatggattgcttatccggatacactcgttggtactgactcgcacaccaccatgatcaacggccttggcgtgctggggtggggcgttggtgggatcgaagcagaagccgcaatgttaggccagccggtttccatgcttatcccggatgtagtgggcttcaaacttaccggaaaattacgtgaaggtattaccgccacagacctggttctcactgttacccaaatgctgcgcaaacatggcgtggtggggaaattcgtcgaattttatggtgatggtctggattcactaccgttggcggatcgcgccaccattgccaatatgtcgccagaatatggtgccacctgtggcttcttcccaatcgatgctgtaaccctcgattacatgcgtttaagcgggcgcagcgaagatcaggtcgagttggtcgaaaaatatgccaaagcgcagggcatgtggcgtaacccgggcgatgaaccaatttttaccagtacgttagaactggatatgaatgacgttgaagcgagcctggcagggcctaaacgcccacaggatcgcgttgcactgcccgatgtaccaaaagcatttgccgccagtaacgaactggaagtgaatgccacgcataaagatcgccagccggtcgattatgttatgaacggacatcagtatcagttacctgatggcgctgtggtcattgctgcgataacctcgtgcaccaacacctctaacccaagtgtgctgatggccgcaggcttgctggcgaaaaaagccgtaactctgggcctcaagcggcaaccatgggtcaaagcgtcgctggcaccgggttcgaaagtcgtttctgattatctggcaaaagcgaaactgacaccgtatctcgacgaactggggtttaaccttgtgggatacggttgtaccacctgtattggtaactctgggccgctgcccgatcctatcgaaacggcaatcaaaaaaagcgatttaaccgtcggtgcggtgctgtccggcaaccgtaactttgaaggccgtatccatccgctggttaaaactaactggctggcctcgccgccgctggtggttgcctatgcgctggcgggaaatatgaatatcaacctggcttctgagcctatcggccatgatcgcaaaggcgatccggtttatctgaaagatatctggccatcggcacaagaaattgcccgtgcggtagaacaagtctccacagaaatgttccgcaaagagtacgcagaagtttttgaaggcacagcagagtggaagggaattaacgtcacacgatccgatacctacggttggcaggaggactcaacctatattcgcttatcgcctttctttgatgaaatgcaggcaacaccagcaccagtggaagatattcacggtgcgcggatcctcgcaatgctgggggattcagtcaccactgaccatatctctccggcgggcagtattaagcccgacagcccagcgggtcgatatctacaaggtcggggtgttgagcgaaaagactttaactcctacggttcgcggcgtggtaaccatgaagtgatgatgcgcggcaccttcgccaatattcgcatccgtaatgaaatggtgcctggcgttgaaggggggatgacgcggcatttacctgacagcgacgtagtctctatttatgatgctgcgatgcgctataagcaggagcaaacgccgctggcggtgattgccgggaaagagtatggatcaggctccagtcgtgactgggcggcaaaaggtccgcgtctgcttggtattcgtgtggtgattgccgaatcgtttgaacgaattcaccgttcgaatttaattggcatgggcatcctgccgctggaatttccgcaaggcgtaacgcgtaaaacgttagggctaaccggggaagagaagattgatattggcgatctgcaaaacctacaacccggcgcgacggttccggtgacgcttacgcgcgcggatggtagccaggaagtcgtaccctgccgttgtcgtatcgacaccgcgacggagttgacctactaccagaacgacggcattttgcattatgtcattcgtaatatgttgaagtaacaactatttgcttgccggttattttgcttccggcaagcaaatgaattacacaatgcaagagggttatttgttcagcaaatggcccattttctcggctttggtatcgagataatgttcgttattggggttacgacctacaatcaatggtacgcgttcaacaatattaatccctgcttcggtcagaatttcgacttttttcgggttattggttaacaagcggacttcattgacgccaaggagtttgaacatatcagcgcaaagagtgaagtcgcgctcatcagcggcgaagcctaactggtggttagcctctacggtatcgtaaccttgatcctgcagtgcgtaagcgcggattttattcagcagaccaatgttacgaccttcctgacggtgatacagcaaaataccacggccttcctcggcaatttgcgtcaatgccgcttcgagctggaagccacaatcgcagcgcaagctgaacagggcgtcaccggtcagacattcggaatggacgcgcgcaagtaccggggtatgcccggaaatatcgccatagactagcgcgacatgatcgtgtccggttgccagttcttcaaatcccaccatcaggaaatcgccccatggggttggcagtttggcttctgccacacgtttaagctgcatgaaattctccagataatgctggttctgtattggcttattttgccataacgagaaggggttcacctaatcacgacgcgtcgatcgttcacggaatggcacaaatctgtcaatttttcctggaactggcgttttcagttatgattgtgggacttatcaaaaaggagaggccatgcgttcgattgccagacgtaccgcagtgggagctgcactattgcttgtcatgccagtagccgtatggatttctggctggcgttggcaacctggagaacaaagttggctactaaaagcggctttttgggttactgaaactgtcacccagccctggggcgtcattacacatttgattttattcggctggtttctctggtgtctgcgttttcgcattaaggctgcctttgtattatttgccattctggcggccgcaatccttgtgggacaaggcgttaaatcctggatcaaagacaaagtccaggaaccacgaccttttgttatctggctggaaaaaacacatcatattccggttgatgagttctacactttaaagcgagcagaacgcggaaatctagtgaaagaacagttggctgaagagaaaaatatcccacaatatttgcgttcacactggcagaaagagacggggtttgcctttccttccggtcacacgatgtttgctgccagttgggcactgctggccgttggtttgctgtggccgcgtcggcgaacgttaaccattgctatcttgctggtctgggcaacgggagtcatgggaagccgcctgctgctcgggatgcattggccacgcgatctggtagtagctacgttgatttcgtgggcgctggtggcggtggcaacgtggcttgcgcaacgaatttgtgggccattaacaccacctgcggaagaaaatcgcgaaatagcgcaacgagaacaagaaagttaacgctggttgattttccgaatttagcccttaaatcatcaacaatgcgtgtggatgccatttcgcagacggcgcgaaaatggtactttaaagggctattgcggtaagttgaccataatttattcgctctaaccacataacgggaagtaatgtgaaatatttactcattttcttactggtgttagcgatcttcgtgatttcggtcacgttgggtgcgcagaacgatcaacaggtgacgtttaattatctgttagcgcaaggggagtaccgtatttccacattgctggcggtattgtttgctgcggggtttgctatcggttggttgatttgtggcctgttctggctgcgagttcgtgtttccctggcgcgcgctgaacgtaaaataaagcgactggaaaaccagctttcacccgcgactgacgtggctgtagtgccgcactcgtcagcggcgaaggaataactttctatgctggagttgttgtttctgcttttgcctgtagccgctgcctatggctggtatatgggccgcagaagtgcgcaacaaaacaagcaagatgaagccaaccgcttgtcgcgtgattacgtagcgggggttaacttcctgcttagtaatcaacaggataaagcggtagacctgtttctcgatatgcttaaagaggatacaggcaccgttgaagcccaccttacgctcggaaacctgttccgttcgcgtggcgaagttgatcgcgctattcgcatccatcagaccctaatggaaagcgcctcgctgacctatgaacagcgtctgttggcgattcaacaactggggcgtgattacatggccgccgggttatatgaccgcgcggaagacatgttcaatcagctgaccgatgaaactgacttccgcattggcgcgctgcaacagttgctacaaatctaccaggctaccagtgagtggcagaaagcaattgatgttgccgaacgcctggtgaagctgggtaaagataaacagcgcgtcgaaattgcccatttctactgtgagttagccctgcagcatatggccagcgacgatctcgatcgtgccatgaccttgctaaaaaaaggggcggcggcagataaaaacagcgcccgcgtatccataatgatgggacgcgtgtttatggcgaaaggagaatacgccaaagccgtcgaaagtctgcaacgcgtgatatcccaggacagagaactggtcagcgaaacgctggaaatgttgcaaacctgctatcagcagttgggtaaaactgccgaatgggcagaattcctgcagcgtgcggtggaagagaacaccggtgccgatgctgaattgatgcttgctgatatcatcgaagcgcgcgacggtagtgaggccgcacaggtctatattacgcgccagcttcagcgtcatccgaccatgcgtgtgttccataagttaatggattaccacttaaatgaagcggaagaagggcgtgccaaagagagcctgatggtgctgcgtgacatggttggcgagaaggtacgtagtaagcctcgttatcgttgccagaaatgtggttttaccgcatacaccctctactggcattgtccgtcttgtcgggcctggtcaaccattaaaccgattcgcggtcttgatggcctgtaatttttaaaaaaaatccgactttagttacaacatactaattattaatgttccattgtgctccggcaacgacggcgcagaaaaagcctgccaggggagaaatcgcaactgttaattttttatttccacgggtagaatgctcgccgtttacctgtttcgcgccacttccggtgcccatcatcaagaaggtctggtcatgacgttaactgcttcatcttcttcccgcgctgttacgaattctcctgtggttgttgcccttgattatcataatcgtgatgacgcgctggcctttgtcgacaagatcgacccacgcgattgtcgtctgaaggtcggcaaagagatgtttacattgtttgggccacagtttgtgcgcgaacttcaacagcgtggttttgatatctttcttgacctgaaattccacgatatccccaacactgcagcgcacgctgtcgctgctgcagctgacttaggcgtgtggatggtgaatgttcatgcctctggtggggcgcgtatgatgaccgcagcgcgtgaggcactggttccgtttggcaaagatgcaccgcttttgattgctgtgacagtgttgaccagcatggaagccagcgacctggtcgatcttggcatgacactgtcacctgcagattatgcagaacgtctggcggcactgacgcaaaaatgtggccttgatggtgtggtgtgttctgctcaggaagctgtgcgctttaaacaggtattcggtcaggagttcaaactggttacgccgggcattcgtccgcaggggagtgaagctggtgaccagcgccgcattatgacgccagaacaggcgttgtcggctggtgttgattatatggtgattggtcgcccggtaacgcaatcggtagatccagcgcagacgctgaaagcgatcaacgcctctttacagcggagtgcatgatgagtgattccaacagccgtctggtctactcaacggaaaccggacgtattgatgagcccaaagcggcccctgtacgccctaaaggcgacggtgtggtgcgtattcagcgtcagaccagtggacgtaaaggtaagggcgtttgcctgattaccggtgtcgatctcgatgatgccgaactgacaaaacttgcagcggaactgaagaaaaaatgcggctgcggcggagcagttaaagatggagttattgaaatccagggcgataagcgtgatttattaaaatcactacttgaagcgaaagggatgaaggtaaaactcgcaggcggttaacataaaaagccacggatatatccgtggctttcgaatattttactgtgcgtattattcagttatttcgtactgaacagaatcaagcgtattataattgcgagtcgataatcgacatttatttacgattatttaccgacctggtgaccaataacacctccgacagctgcaccacctaatgtacccaacgtactgccatcggtcagtactgcaccgcctaatgcccctgcacccgcgccgattgcggtgttgcggtcccgtttagaccagttagaacaggcactcagagacattgccaaagtaattgccagaacagccgcggtcatttttttgctcgttacaaacataatactctctcctgaatttatgattcacggaagtaagctctctataactataatagctaagaataagtctggtgaaattattccgtgaaatctgctcgcgcgcagggttatatcacgcaggtgataatgacttcctgttatatcgctgataataattttatatcttgagagtgttaataacaggtaaatagtcttaattatcaaccaggaatcatcttagagcggatgatttgccaaactgcaaatcatccgtagagaagggaaatggttaaatgtcaacgacgtgaatggtgagtttactgtgctcaagatgcatcagatcgctggcgcgtattttcgaatcggtaatcacgcgattgaatcgctcaacgggaccgatggagtatgaatgtacagcaccaaatttcgagctgtcagtcaggactatcgcttcgcactctttttccagcacggcattgaccacatcggtacgcatcatatcgcgaccggtaaatccagtttcaggttgccagccatcaataccaataaatgctttgctgaaatgcacctgttggatgcactggcgtgtcaaagggccaaccatactttcgctttttttctgatacacgccaccgagcaaaataacttcacaaggcgcgtctttcagcaaatgcgcgatgtagctgctgaccgtgatgatagtgacatttttcttctgctcgcccagagtccgggcgagtagggcattgctgctgccattttcgataaagatggtttcgcccggttgaaccagcgacgcggcaaactcggcgagttcacgcttcagcgtatagttgctcatcatacgggtttcgacgtcatcactatcaagcgaaacagcaaagccatgtgcacggcggaggtaactcagtttttcgagtgtgttgagatcctggcgaatggtaacttcagaaactccagtggcttttgccagatcggttacgctaacctgaccctggtcaatgaccatctgtagaatagtttgttgtcgggaattcatcgctgtaattcttataacgttataatacttaataaaaaaatactgacgcgccgggcatcctcaaataggaaaacctgaaggcacgattgttaaatctcccacggtgccttcgggatgtctggcgtagattcagcaacctggcgcaagagttctgctttaagtatctcgagattatggatcgcagagtggtaatcgcctgccacaaggatatctaacacaatatcaatacgttcggcaacgcgctgggcatcaaattcagacatcaaggacatccttatagcaaaagggggaaaatgaataatgcaaaaattgccgctaaaagagaagtgtttaacagcaacggctaattatcatccaggaatacgatatataatgacgggatatagcgctaagtatatatattcatctacttatgcgcgcttcagatagcgtttataccagcgttcgaaggcgacggcgggcatcggtttggcaaacaaaaatccttgccgctcattgatcccgttcttggttaaaaaagcatcttcctttgcactctctacaccttcggcgatcacctgaagattcaatgcctgggccacagcgacgatcgcccggaccagtgactgcgagacaggttgtttgtgaatatctcgaacaaaaacctggtcaagtttgatggcatcgatcggaaagcgcgccagttgcgaaagtgaagagtagccggtaccaaaatcatccagatgcacttgcgcacctagttggctaaattgttgaataacagacagtgccagttcatcattctcaatcagacaactctctgtcagttcaacatctatagggcagtattcaaaattgagttcctggagaacctgtttcagggcggtgaaaatggtttgatcggcgagctgacgtgcagaaatatttaccgccactcgcaggtttatgcctttatcccgccactttgccacctggcgtacgacatcgagaatcacccaacggcctaaaggcacaattagccctgactcttcggcgtaggaaatgaagtccaacggtggaatcaacccacgttcaggtgactgccaacgtactagtgcttccagactgcgcacttcgccacgccaggtgattttcggttgatagtgaataaccaactgatcgttttccagtgctttacgcaagttggtatccagccagagatattcaaatacccgttgattcatttctggggtaaaaacgcaaaattgtcctcgtccgccttccttcgctgtgtacattgctgtgtcggcgtgacgaataatagccgtgctgtctgaaccatgttcgggagagagtgcaatacctactgaacagctggtataaacttcaattaaaccaatgcgaaaggggagccgtaagcgggtcaaaattcgtgatgccattgcttccagcgcgctttgtgaggtgttggatgccagtaccagaaactcatccccacctggacgcgccaacacctggtcatgttcgagacagcttaaaatagccaatgacacgtcgcgtaataactggtcaccaaacaaatgcccataggcgtcgttgacctttttgaaattatccaaatcaagatacacaaccccaactttattgttatctgcatgattaatagcgtgatcgattaaatcctgcattgcgttacgattcggcagtccggtgatactgtcggtatttgccagaatacgcagtcgctcctgagcgcggcgctcttcggtaatgtcggtgccggaacagattaaaaaaatctcgtttttgccactgccgctgtggacaaatttattgcgaaacagaaacagccgctggcctttacatgttggtatccacagttcgacttcatatgcattgccgcttcgaaaaaatacacggttattgcgcctggatgccgcagcttcacgacggctcataaacagtttaaacacgctttgcccaatgacgtcgtgttctttcaaccctgtgtaatcttcacataaccgattgaagcgttggatattcccccggctgtcgagaatcactattgcggaatgtgcttcagaaactacctgctcagcaaaggaaagcccgtgtgataaatcacgagcaaccgccggtgtgtcatgccatgcagacgcgttgccagcccattcccgtttattgatttttcgtcctaccagatgcacagaaagatcgctttcatcgacggtcagactcatcatcaggctggaggtgatgaccgtcatttccctgatgcgagcagcctgttcggcagataactgcaatgtacgatcaggttctgtggtttcggtggtagaaaagcgcaaaacatcgctgctttccgtcaaccgccagtatggattgtgcgatccgagaaagttgtacaacgttgtggactccctaacggttttcatgatgcatatcctccggttaacagcggagtccgcggttaaataaaaggaacaacatgacttacatgaaattaacggcggctaaacgcattgttttttttatatatttatttgtaatccagttttggaaaaacgccagttttcaaacgaaagtcagttaaaaaatctgcctggatataacgaaggtagagcggggaaataaacggcccatccatgaggaatgggccgtgaaaggagattacgcgaccgggcgcgcaataatgctgcgggtttccatgcggacttcggcaatagtgacgtcaataacgtcagtcactttgtaaaccgtttcacctttaatttgtacagtgccgttttcctggctgcaaaccagttcatcgcgcacagcgtgtaagaaaggtgccggaataaaggcgatagcgccgttatcaaccaaacgaacacgcatgccgccacggctgatatcgacaatttccgctgcgaaacgggtgtcggtcccggctttgtctttcaggaagcgtgcgtataaccagtcaccaacatcacgttctgccatccggttgagacggcgacgctcggccatttggacagtgatttcatcctgtgggcgcgtcgcagtttcgcctttgataaccgctttcagcagacggtggttgatcatgtcgccatatttacggatcggcgaagtccaggtggcgtatgcttccagaccgaggccaaagtgaggaccgggttcagtgctaatttcagcaaatgactggaagcgacgaatgcggctgtcgaggaaaccagttggttgcgcgtccagttcacgacgcagtttgcagaaaccgtccagcgtgagcacttcttcggcatcgacatgcagaccgtgcgttttcagcaacgctgccagcgcgtcggcattcgccggatcaaagcccatatgcacgttatagatgccaaaaccgagcttatcgcgcagtacgcgggccgcacaaatgttagcggcaatcatcgcttcttcgacgatacggttggcaatgcgacgaggctcggcgacgatatccagcacttcacctttttcaccgagaataaagcggtaatccgggcgatctttaaacaccagtgcgtggttatgacgccactcgccgcggcgttggcaaatttgcgctagcaaacggacttgttcggcaattgcttcactttcaggctgccagtcaccggtattttccagccagtcagaaacctggtcatacaccagctttgctttggattcgatggtggcggcaaagaattcgatattatcttcaatggtgccatcagcggagagcgtcatgcggcatgccagtaccgggcggacttcattggcgcgcagtgagcagagatcgtcagaaagctcgcgaggcagcatagggatgttgaagccaggcagatagttggtgaatgcgcgaattttcgcggctttgtccagcttgctgccttcagcaatccacgcggttggatcggcaatcgccacaatcagctgaagtttgtcatccggcaacgccttagcgaaaagggcgtcatccatatcttctgtgctggcactgtcgatggtgacaaaatccagcgcggtcagatcttcacgaaccagaccttcatcgagcatttcggtagcgacgccgtctggtgcttctttttccagattatggcgtgcaagggtaacccaccacggtacaaagtgatcgtcaccaaaagtgatgtattgtgtcagttctgcatagaaagaacgatcgcctttcagcggatgacggcgcatttcggcaaccgcccagtcgccttctttaaactcgtggttcaggccacgggctgcgcggcaaggaatggcgtcttttaagagtggatgatcaggaacgatggccagacggtcatttttgccctgaaccttacccacgaaacgagtcaggaacggttcaaccagttcttctggctctgcggattcacgttctttttcactgtggatcaccgcgataattcggtcgccatgcatgacttttttcatctgcggcggcggaatgaaataacttttttgcgcgtcgacttccaggaagccaaagcctttttctgtggcttttaccaccccttcagcgcgtggcgtctgggaatgcagttgctgtttaagctgcgctagcagcgggttgtcctgaaacataattgtctattttggtggccattagagcggctgacagttttacgcgaatctgtctgacgcggcaaggttaatatgtctcacccaacgcgatttttaagcgatttatccagccacacagcccgctccataccagcagattaataatctgcgttgatgatttttcgtgttcgagtaaagggctgaactgggcggcgctaaagcgatcgggtgctcgggtcagccattgtatcgcctgaacggtagcgcgctcaacagaatgacggtcagcccattggttaatttcattttcgcccttgcgcataagggtgctgatttttttatattcatttgatgaatccatacaggtggcaaaacaagcaggactgccatttatacgcgcgcataacaacgccgcaagctgattatccggctgtgtattgccccgtgtgctgtttaacaacttttcgagaagggaaagtgaaatagggtggagagagagtatttcggccagttggcaaagttctgcagttgaactttttgtgtgctcttcaggtagtttttccacctcatagctgcttcgccagcgtaatgattcatcagcaaacagtgacgcgtcggcgtagttttgtatctccagcccgggtaaccagcgtaccggatgcccgagataagcctgaaatgtcgcaattgtccgcgcctgaaagccaataaaaccaatgatttggctaatgatcacacagtcccaggcagtaagaccgacgtcattcagatgctggcgcgatcggttgtcgataatagaaggcgagctagccagttggcgggcatattgcgtgatttgtgccaaccgatgattactttccctggtggaatcaggcccggggagcggcgtaagtcgcgccgaatagtagttacataaccgctggacgccgcaaacctgagcaaccgtcagggccgtcgacaagcgttcataagcggtgaaggtctgtgaacgggtcacggtaagctggtcagggaacaaatccactgcaagaacacgcgcagggtccagccatgaaaggaagggggccagcgtttctttttcaaggatcacgtcgagtagaaagggatcgctgacctttgcggcttccgggaccagaggcagaacgtcatactccgtagtactggattgcgtttcatgataccagtggcttttgccggtgatgtggcgttgttccatgggcgctccttggtcgtaaaggaaatcgttatcctgacgcaaggcgggaaggggagaaagacggatcggcgataacaaatatcagaaaggtataacagagataacgggcggcagaacgccgcccatctttaccaacagaacgattatttcagttcgagttcgttcattgcagcaatgctgaaaccgccgtcaacgtggaccacttcaccggagataccggcagagagatcggagcacaggaatgccgcagagttacccacatcttcaatagtaacggtacggcgaatcggggtaacggcttcgcaatgagccagcattttgcggaagtctttgataccggaggccgccagagtacggatcggaccagcagagatggcgttaacacgcacaccttccggacccatcgcgttcgccatatagcgcacgttcgcttccagagacgcttttgccagacccataacgttgtagttcgggatagcgcgctcagcgccaaggtaggaaagggtcagcagggcagaacccggattcagcatggagcggcaagcttttgccattgcaacgaagctgtaggagctgatgtcgtgggcaattttgaagccttcacgggtaacggcgttaacatagtcaccatccagctgatcgccaggtgcaaaaccaatagagtgtacgaaaccgtcaaatttcggccaaactttccccagttcagcgaacatggtgtcgatgctggcatcttctgcaacatcgcactgcagaacgatgtcagaacccaattgagcggcaaattcttctacgcggcctttcagtttgtcgttctggtaggtgaatgccagttcagctccttcgcggtgcatcgcctgagcgataccgtaggcgatggatagtttgctggcaacaccggttaccagaatgcgcttaccggaaagaaaacccatagctttaatccttattgttgatgcttgttgtgcctgaaaatcaggcgattcgtcgttttagtaaacagtacgaacagataaacggttattataatcaacctggctgtgagtagctatagttgccaggtccgaccggagcaggctgcggcagggggggcgcttttcccctcaccctaaccctctccccagaggggcgaggggaccgtattgtgcaaatattgttaccccagcaacaaacaggctcatacagcccctaaccctttcatggcgatggctgggacggttcagaccttgccgaatattctccagcaccgtctccatgttttcaccacaacagctattcggctcggtctgccccctcgctctttcagggagagggtgaccggcggttcagttcctgcagaatattctccagcaccgtctcctcattacaatcaatctcgttattccagaaacgcagcacggtccagccctgcgactcaagccagctagtgcgcctggaatcataggcaactgctaaatcatgctgcccaccatccagctcaacgactacacgcgccgagcagcaagcaaaatcgagaatgtagctccccactggatgttgacggcgaaatttgaaatcactaaaacgtcggctgcgaagatatcgccagagctttcgttcctgcaaagtgagattgcgtcttaaatcacgcgcatttgatttaattttatctatcacctcattctgacaagatttaatcttttgtcagaatgaggtgaataatctggaaggaggattcagaaaattagcgatctttacgccacgcatccgccgtcaatgcctcgccaaaatgaccggcaatcagccgtttggtgagttcatgcagcggcgatgccagcacatccgcggtgctgcctcgctcgacaacctcgccctgatgcatcaccagcacctggtcgctaatgtgcttcatcattccgatatgctgggtaacataaatatacgaaatgccctgtttttcctgtaattccagcatcagattaatcaactgcgaacgcatcgacatatccagtgaagcgagggcttcatcggcaataatgacttttgggcgcaatatcagcgcgcgcgccagacccagacgctgtttttgtccgggtgccaacatatgcggatagtaactgacgtgatccggtagcagcccaaccatacgcatcgtttcaataatctgtttgcgacgctgttccggttccaggtcggtgttcaggcgcagtggaaaatccagaatttgcgagatacgttgacggggattcaacgaggtcgaaggatcctgaaaaatcatgcgaatacgctgactgcggaaggaataatcgccaaaatgcagtggatgatcgtcaatcaataactcgccgctggtaggctctatcattcccgccagcatttttgccagcgtggatttacccgaaccattctcgccaataatcgccagtgtctggccttcacgtagcgtaaagctcaagggttttaccgcttctacggtctgacgacgaaaccagccggtccggtagcggaacgttttacttaaattacgcacttcaagcagcgtttcgatcatctcactctttctccatgttcagcgggaaatgacaggcatagagatgatttttcgcccccgtcaaacgtggcgtcacaatgcattctcgttgtgcatacgggcaacgtggccccagacgacaaccaatcggtaactgttccagcagtgggatagcgccgggcagcgtattgaggcgacttttatgcggcatcgcgctgccgaagtctggtatcgcgcggatcagcgcctgggtataaggatgatgtggcatcgtcaccaactccttactcggcgcggtttccactgtttgaccgcagtaaagcacgttaattttatccgcccattggctaagcatttgtaagtcatggctgataagcaaaatagtggtattgctgttttggttgagacgcgtcagcaggcgaaagatttgcgcctgggttgttggctccattgagttggtcggttcgtcagcaatcagcagacgcggttgattcgccagtgcaatggctatcatcactttctgacattcaccttcggtcaactcatagggaaaactgcgcatcgcatctttgtgatctttaatccccacgcggtgcagcagttcaatggcacggcgtttgcgccagccaaaacgctgccaccaacggcctttataggtccaggctgggatgttttgcatcaactggcggcccacacgttctgaagggtcaagacacgactgcggttcctggaaaatcatcgacacgttatggccaaccagtttgcgccgttcgcgtgcggagagacgcagcaaatcgatatcatcaaaacgcatacggtcagcagtaacacgccagttatctttattcaccccacaaatcgctttcgcaatcaaactcttgccggaaccggattcaccaacaagaccgcggatttcaccttcggttaaggtcatacttacccggtcgacggctttaacccactcatcaccggttttaaattcaatggtcaggttacgaatatcgagtaatggcattattccacccccgcaataatcgcacgacgaacgccatcgccaaggaggttaaccaacaacacgctaatcataattgccgcacctggcagcatgacagtccacggggcgacataaatcagttccagcgcatcaccgagcatcgctccccattcaggcgaggggagttgtgcgccgagatcgagaaagcccagcgcggcgatatcgagaattgccatcgacagtgcgcgggtgatctcggtgaccagcccggcggtgatgtttggcatcacagcaaaccagagaatattcagcgttgatgcgccatccagacgggcggcgataacgtactctttttccagttcgtcatgcaccatgctgtaaatcgaacgtaccatacgcggcagcaatgccagccagacagcaaacatagcgtgggacaaactcggtccggcaaacgctacaacgataattgccaacagcagcgaagggatcgccagtaaggtatccagaatatggttaagcaccgctgagcggaggccgtgtgtcgccccggcgaaggtgcccagtaccaggccacagatcgtcgcggcaagcgtcaccacaaatgcgccacccacggttggcgcagctccgctcagtaaacggcttaaaacatcgcgtccgaggtcgtcagtccccaggaagaaagaaacttcgccatagcgcgaccatgacggcggcaataattgataaccgagaaattgctggtcgatgccgtaaggcgcaaaccagccgccaaaaatacacagtacagccagccccgcgcagccgtacaggccgaccatcgcagaggcgtcactataaaatttgcgccaggcggtacgcagcgtgcccggcgggcgcttttcgctgtatacgctatcgtaaggcataccattccttatgtttcagagggttagccatggcacccaaaatatcagaaatcacgttaacaataatgaccagtgagccacacaccatcactccggcggaaatggctgcgtaatcctgctggcggatggcgttaattaaccagcgccctaaacccggccagctaaaaaccatttcggtgatcatcgccagcgtcagcatggtggaaaactgtaagcccaggcgaggaataaccggcggtaacgcgttatgcagaacgtggcgacgcaaaatagtaaagcgcgacaaaccgcgggtcgccgccgcttttacatagttctggtcatacacttcgatagtgctgatacgcatcaggcggatcacttcagttgttggcgcaaccgacagggtgatcacgggcaatatcatatggcggattgcgctcatgatcatttcatcccgccatggtgagtccgaaagccaggcatcaatcaacgcaaaaccggtaatcggtttcacttcgtagagcagatcgaaacgccctgaaacgggcaaccaacctagcgtgagtgaacaaaacagcgtcaacagaagcgccagccagaacaccgggattgaaaagcccagtaaggcgatggcgttgatcaagttatcctgccacttatggcgcgtaatcccggcaatcatccccacggggatgccaacaatcagcgcaaaaccgaaggcgaggatgcacagttccatcgtcgccgggaagacctcttttaactgttcggcaatcggttgaccgttaatgctggaaacaccaaaatcccagtggatcaggccgttaaaccagaacacccaggcattccacagtgacgcgccttgtaacggcgcatgaggggtgaaatagctcaagctgaagccaacgaaggtcagcaggaacaaggtgacaatcaataacaaaatgcggcgtaaggtgaagataatcatggttttttcacctcatcctgtttctcgcgatacaccccagcaaaggaggcgttaccaaacgggctaagtaccagacctttgatatcgtaccgataggcctgcaaacgcaatgacgacgccagcggcaaaatgggcaattcctgcgccagaatactctgcgcttcgtcataggcttcaatacgcgccgccagctgctgcgaagagagcgccttacgcaatacgctgtcgaatttcggatcgcaccagtgggcgaggttggtctgcgaatgaattgccgcgcagctcagtaacggacggaagaaactgtccgggtcgttactgtccgtcgcccaaccggataacgtcagatcatggctcatatccatcaaccgcgcctcctgaaagcgaccttctaccggcacaatcaccacttttacgccaacctgcgccatatccgcctgaatcagttcggcagttttcagtggactggggttccacgcctgcgaacgtgtgggcacccacagtttcagcgttaaattttccagccccaacgacttcaactgttcgcgcgatttcgccggattgtattcagtaattttagcctcgttgtcataggcccacgaggcgcgcggtaaaatagaggccgccgtttcagccgtaccataatagatggattgcatcaggcgctggttattaatcgccagtgccagcgcatggcggacagcgggattatttagcggcggtttggcggtgttaaatgccagataggcgacgttcatcccaggacgcagcgttaaacgcaagcgcgggtcgtcacgcaaaatggatagctggctggcagcaggccaggccagaacgtcgcattccccggtcaggagtttcgacagacgtccggtgccgccggagcctaaatccaccactacctgcggcattaacggtttaccgcgccagaagtcatcatgacgttgtaggcgaataaattgcccggcgcggtattccgacaactgatacggaccggtgccgaccggttgacggtcgagttgctcctggcgatcttctttctctaacttccgggcatattctgccgacatgaccgaagcataatgggttgcgaggtgccacaaaaaagaagcatccggctgggcgagtcggaactcaacggtatgattatccagtttgcggacgcttttcacgttatcggcaaattgcaggctgtcgaagtaggggaagttgctgccgttgacgttatgccacgggttgttgcggtcaaaaattcgctggaaggtaaacaccacatcgtcggcattcattttacgagtgggagtaaaccagtcggttttttgaaacggaacatcgcgacgcaggtggaagcgataggtcgcgccgttgtcgagtacttcccagctttcggcaagttccggcatcaggcgataggtatagggatcgacatccagcagtcgatcataaaactgggcggcaagggtatcgacaattaacccactgctcgctttggatgggttaaaggtgttgacttgcccgctgacgcaatagacaaaaccgctgtcgcggatatcagcatgcgggggagattcaggcgcggcgattgcctgaccactcacaagtccagcaatcaccaaaagagacgataatacctggcgcataatattaagggattttatgtaaagaggctatcttactaatatttaatgacatttgccattaccgtttgtgttcaggggtcgtaatgagggccgtgtggttggtcgttgaacaggtgacgtcgccatctgttcaacattcgtacccgtgatttctctataactataactcacagaacaacttagcgaggagcagagcggtacgatcgtgagaaacccattaaagcacgctgcagtgcgtgtcattgttagccagatgcggcgtgaacgctttatccggacaacgatactgaccgatcgtctgcaattaaatcattactcattaccccattgattcaaaaactctgcgatctcatcaatgcgtacgggattaatccccgcttcagcagccatttcatgttgggcttcttcgctgatctcttcattgttcatcaaacgggtgagcagtaactggaagtagtgggccagcggtgtgcgttcagcctctgcgacaggctctgcgcattcggtcgcgtactcatcggcaatatcaaaatattttagcgggatatcgtggttcattatttgcccctggggttaatgcgctaagcataagggcggatgatagcactcgtgatccgggtcatacatctttttatagttaatggcgcggcgcgttaccctcaggcaggataatgcgccgcgcatccgactattacgtttcactcaccggcgttctgtcaccatcatacaacggcactttgcgatagcggcggatcagataccataaatatgcgccgcctaacgaagcccataccagaccgagtgtcagtgacgttgactcgaggttaacccacagcacacccaccgtcagcgcgccaaccagcggcatcagcaaatagtggaagtgatccttccagcttttattcattcctttacgccgccagaaatgattaaacaccgacagattcacgaaggtaaacgccaccagagcaccgaagttaattaacgctgtggcggtaactaaatcgaagaacagcgccgacaacgcgacaatcccgaccataatgacgttgagtgccggagtccgccattttgggtgcacatagccaaacacgcgctccggaaacacattgtcacgccccatcacatacagcagacgcgacacgctggcatgtgaagccaggccagaggctaacgtgttcacaaacgtggtgcagaggaaaatcgactggaagagcttgccgccgacgtacagcgcaatttcaggcagtgcggcatccggatctttaaagcggctgatatcgggaaagaacagctgcataaagaacgacgccgcgataaagataacgccaccgtagaccgccgtcaggaagatggctttcgggatcacgcgtgcggcgtccggcgtctcttccgaaagcgtggtcaccgcatcgaaaccgaggaaggagaaacagacaatcgtcgccccggtaataatcgggatcaggtgcgcgttctcgctgataaacggctgaagtgaccagacggtgccaacgccttctcctttatgcagtccctgaactaccaggaagataaacaccaccatgatggagatttgcaccagtacaaacagggtattgaagttagcgaccaggttgacgctcttcagattcgcggcggttaaaatggcgacgaaggttaccacccacacccacggcggcacttccgggaagagggcggagagatagattttcgccaacaagacgttaatcatcggcaaaaagagataatccagcagcgatgaccagccgaccataaatccgacgtgcgggttaatcgacttttgcgcgtaggtataggccgaaccggcctccggaaactggcgaaccagtttgccgtagctgatagcggtaaacagcacacccgccagcgccagcaaataggacgccggaacgtgaccgtcgctaatgccggagacaataccaaaagtatcaaatacggtcatcggcgtgagataggccagacccatcatcaccacctgccacaatttcagtgattttcgcagacgggttttgccgggttgcgcagcaatattcagtggtgaattaatagccataattgctgcctcccctgcgtaataaggtttgcggtcgtgtcgacctgaaatcaaacctgtttagcaagggaagcaaagggggcggagtccagtcagtagcaggaggggcgcatacgcagcctccctcgccatgcggggatttaatcatcggcatcatctcatttcctcgtcacagtcttaatcgttaacggaagcccgttgccgcccgcgctccataacgcgacatccgggaaatgtctggattaccagcaaatgtcaggcctggctccgctcaggccgatgaaacaaccccgcaaggggtattacgcgtttttcaacatccactcaatttctgtttctgtgatgaggcgctcaaactgcaacagctcatcatttttacaggcgtgatagacatggcagaagcgttcgcctaaatagcggcgcaggtgatcattctcgataaactcacccagggcatcgctctggcgaatcggaaagggtaagccttcctgttccagcccgttgccttcgacttcttcctgcaacggcagctcgttatcaaggccatgcaaaataccggcaaaaatcgctgccatcaccagatatgggttggcatcggcacccgccacgcgatattccacgcggtgattatgacggtcgccgcacggaatacgcagggcgacggtgcggttgttatggccccacgacgcctgcgtcggcacatacattcccggctggaagcggcgatacgagttcacgtttggtgccagcaacgccatcgacgacggcatcaggtcaatcatcccggcgagcatctttttcagcagcggcgaatcttcgccttccgcgtcagaaagcacgttctcgccacgattattttgcatactgatatggatatgcattccgctgcccgcgtgctcttcatacggcttcgccataaaagtggcgtgcatcttatgcttttctgccatcagacgcaccaggcgttttagtgccagcgcatcatcgcaggcttccagcacgttatcagtatggtaaaggttgatttcaaactgacccggcgaggcctcagcgaccgcgccatctgccggaatcagctgtaactgcgccagttcatcaatatcattgagcacgtcggcgaagtggttgaggttatcaacggagtaaacctggctttgtgtattgcggtcatcggtgccaggcgcgcagggcggttgcagatacccttcagcgtcgcgctggcgatccagtaaatagaactccagctctaccgctacgaccgggaacaatccgcgctggcgcagctgctgccacaggcggttaagaacgttccgcggctcaacgtcaaagggagcgccatcttcatcgaccatggtcaggagcatctgaccgataaactctggatcggcggcagaaggagttaaggaaccgagaacaggaacacaggtacgatccggctcgcccatttcctgacccagacctgcttcttctactacgttgcccagaatatccattgcaaataccgaggccgggaaataacaccctttctcgagcttcttcaggcttgaaacaggaatacgctttccacggaagcaaccatttaaatcggtaagtaaaacatcaacatattgcgtattcgggtagcgctccaggtagcgtttcacttcctgcgtaaaggcgctaccccgcctctcttctgactgctgaacaaagttctctacttcaacgatattggtttccatgattcttcgcctttggtttgttttccgctcgttatcaaagcgtaaaatataatgaccaccattcgaatctgtatgcaaactaaatgtttgtcaaatgttaaattgagtttgcaaaaatgaaaacccactgctagattgaaaaaatattgaacataaaggtcatttaaagcgcagtaatggcgataatttagtccactttgtgagattgagcatggaaaatataatgaacaatccggttatcggtgtcgtaatgtgcaggaacaggcttaagggtcatgcgacccagactctgcaagaaaagtacctgaatgccatcatccatgcaggcggcttgcctattgcgctaccacatgcgctggcggaaccgtcattacttgaacaacttttgccgaaactcgatggcatttatcttcctggtagtcccagcaatgtgcagccgcacctatatggtgaaaacggcgatgagcctgacgccgatcccgggcgtgatcttctgagcatggcgataattaatgccgcactcgaaaggcgcatccccattttcgccatctgccggggtttacaagaactggtggtggcaaccggtggttcgttgcatcgcaagctgtgcgaacagcctgaattgctggaacatcgggaagatcccgaactgccggtggaacagcaatatgcaccgtcgcatgaagttcaggttgaagaggggggattactgtctgcgttgttacctgaatgtagcaacttttgggtaaactctctacatggacaaggggcgaaggtcgttagcccacggttgcgtgttgaagctcgctcgccggatggcttagttgaggcggttagcgtcatcaatcatccttttgcgctgggcgtacagtggcacccggaatggaacagtagcgagtacgcgctttcgcgtatattgttcgagggctttatcaccgcttgtcagcaccatatcgctgaaaaacagcgactctgaccactacagtttaaggaaatgcaaatatgagtgatgagggactggcgccaggaaaacgcttgtcggaaatccgccagcagcaggggctttcacaacgtcgtgccgccgaactctccgggctgactcacagtgctatcagtacgatagaacaagataaagtcagccctgccatcagtacgctgcaaaagctgctgaaggtgtatggtctgtcactctcggaattcttttccgagccggaaaaacctgatgagccgcaggtcgtcattaatcaggacgacttaattgagatgggtagtcagggtgtgtcaatgaagctggttcataacggtaacccgaatcgcacgctggcgatgatctttgaaacgtaccagccgggcacaaccactggggaaagaattaagcatcagggtgaggaaataggcactgtactggaaggtgaaattgttctgacgattaatggtcaggattaccacctcgtcgcggggcaaagttatgccattaataccggcatcccgcacagtttcagtaatacgtcggcaggtatttgccgaattatcagcgcccatacgcccaccacgttttaatctttttgttctgtaagccgggtaagcgcaatgcgcccggcaatctatacacaaaatcattcaagttgcatcaaggcggcaagtgagcgaatcccgatgagcttactcaggtaagtgattcgggggagcgaacgcagccaaggcagaggcggcttgaaggatgaagtgtatataaagaatgtcgccagaaataaacgggcatacggcccggggatctctgcgccctgacgttcacaaactgcatatatctgatagacgtgaaacaggagtcataatgaattttcatcatctggcttactggcaggataaagcgttaagtctcgccattgaaaaccgcttatttattaacggtgaatatactgctgcggcggaaaatgaaacctttgaaaccgttgatccggtcacccaggcaccgctggcgaaaattgcccgcggcaagagcgtcgatatcgaccgtgcgatgagcgcagcacgcggcgtatttgaacgcggcgactggtcactctcttctccggctaaacgtaaagcggtactgaataaactcgccgatttaatggaagcccacgccgaagagctggcactgctggaaactctcgacaccggcaaaccgattcgtcacagtctgcgtgatgatattcccggcgcggcgcgcgccattcgctggtacgccgaagcgatcgacaaagtgtatggcgaagtggcgaccaccagtagccatgagctggcgatgatcgtgcgtgaaccggtcggcgtgattgccgccatcgtgccgtggaacttcccgctgttgctgacttgctggaaactcggcccggcgctggcggcgggaaacagcgtgattctaaaaccgtctgaaaaatcaccgctcagtgcgattcgtctcgcggggctggcgaaagaagcaggcttgccggatggtgtgttgaacgtggtgacgggttttggtcatgaagccgggcaggcgctgtcgcgtcataacgatatcgacgccattgcctttaccggttcaacccgtaccgggaaacagctgctgaaagatgcgggcgacagcaacatgaaacgcgtctggctggaagcgggcggcaaaagcgccaacatcgttttcgctgactgcccggatttgcaacaggcggcaagcgccaccgcagcaggcattttctacaaccagggacaggtgtgcatcgccggaacgcgcctgttgctggaagagagcatcgccgatgaattcttagccctgttaaaacagcaggcgcaaaactggcagccgggccatccacttgatcccgcaaccaccatgggcaccttaatcgactgcgcccacgccgactcggtccatagctttattcgggaaggcgaaagcaaagggcaactgttgttggatggccgtaacgccgggctggctgccgccatcggcccgaccatctttgtggatgtggacccgaatgcgtccttaagtcgcgaagagattttcggtccggtgctggtggtcacgcgtttcacatcagaagaacaggcgctacagcttgccaacgacagccagtacggccttggcgcggcggtatggacgcgcgacctctcccgcgcgcaccgcatgagccgacgcctgaaagccggttccgtcttcgtcaataactacaacgacggcgatatgaccgtgccgtttggcggctataagcagagcggcaacggtcgcgacaaatccctgcatgcccttgaaaaattcactgaactgaaaaccatctggataagcctggaggcctgaaatgaccgaacataccagcagttactacgccgccagtgcgaataaatatgcaccattcgacacgctgaatgagtcaatcacctgcgacgtttgcgtggttggcggcggctataccgggctctcctccgcgctgcatctggcggaagcgggctttgacgtagtggttctcgaagcctcacgcatcggctttggcgcaagcgggcgcaatggcggacagcttgtgaactcctacagccgcgacatcgacgtgatcgaaaaaagctacggcatggacaccgcccgtatgctcggcagcatgatgttcgaaggtggtgagatcatccgcgaacgtatcaaacgttatcagattgactgcgactaccgccccggcggcctgtttgtggcgatgaatgataaacagctcgccacacttgaagagcagaaagagaactgggaacgctacggcaataaacagctggaattgctggacgccaacgccattcgccgtgaagtagccagcgatcgctataccggtgcgctgctggatcacagcggtgggcatattcatccgctaaaccttgccattggcgaagcggacgccatccgcctcaacggcgggcgcgtgtatgaactttctgccgtgacgcagatccagcacaccacgccagccgttgtgcgaactgccaaaggtcaggtgacggcgaagtatgtgattgtcgccgggaatgcgtatctgggcgataaagtagagccggaactggcgaaacgcagcatgccgtgcggcacgcaggtgatcaccaccgaacggctgtcggaagatttagcccgttcgctgatcccgaaaaactactgtgtggaagactgtaactatctgcttgattactaccgtcttaccgccgacaaccgcctgctgtacggcggcggcgtggtctacggcgcgcgcgacccggatgacgttgagcgccttgtggtgccgaaactgctgaaaaccttcccgcagctgaagggcgtgaaaattgattaccgctggacgggcaacttcctgctgaccctgtcgcgtatgccgcagtttggtcgcctcgataccaacatctattacatgcagggctacagcggccacggcgtgacctgtactcatctagccggacgtttgattgccgaactgctgcgcggcgacgccgaacgtttcgatgccttcgccaatctgccgcattacccgttccccggcgggcgcacgctgcgtgtgccgtttaccgcgatgggcgcggcgtattacagcctgcgcgatcgtctgggcgtttaatttccgattaaccgtgaagagtcaaaaggtgtgaaacatgagcaacaatgaattccatcagcgtcgtctttctgccactccgcgcggggttggcgtgatgtgtaacttcttcgcccagtcggctgaaaacgccacgctgaaggatgttgagggcaacgagtacatcgatttcgccgcaggcattgcggtgctgaataccggacatcgccaccctgatctggtcgcggcggtggagcagcaactgcaacagtttacccacaccgcgtatcagattgtgccgtatgaaagctacgtcaccctggcggagaaaatcaacgcccttgccccggtgagcgggcaggccaaaaccgcgttcttcaccaccggtgcggaagcggtggaaaacgcggtgaaaattgctcgcgcccataccggacgccctggcgtgattgcgtttagcggcggctttcacggtcgtacgtatatgaccatggcgctgaccggaaaagttgcgccgtacaaaatcggcttcggcccgttccctggttcggtgtatcacgtaccttatccgtcagatttacacggcatttcaacacaggactccctcgacgccatcgaacgcttgtttaaatcagacatcgaagcgaagcaggtggcggcgattattttcgaaccggtgcagggcgagggcggtttcaacgttgcgccaaaagagctggttgccgctattcgccgcctgtgcgacgagcacggtattgtgatgattgctgatgaagtgcaaagcggctttgcgcgtaccggtaagctgtttgccatggatcattacgccgataagccggatttaatgacgatggcgaaaagcctcgcgggcgggatgccgctttcgggcgtggtcggtaacgcgaatattatggacgcacccgcgccgggcgggcttggcggcacctacgccggtaacccgctggcggtggctgccgcgcacgcggtgctcaacattatcgacaaagaatcactctgcgaacgcgcgaatcaactgggccagcgtctcaaaaacacgttgattgatgccaaagaaagcgttccggccattgctgcggtacgcggcctggggtcgatgattgcggtagagtttaacgatccgcaaacgggcgagccgtcagcggcgattgcacagaaaatccagcaacgcgcgctggcgcaggggctgctcctgctgacctgtggcgcatacggcaacgtgattcgcttcctgtatccgctgaccatcccggatgcgcaattcgatgcggcaatgaaaattttgcaggatgcgctgagcgattaatagcccaacgcaataatgtctgatgcgctgcgcttatcaggcctgcaaacgacgtattgattatgtatgccgaataaagcattcacgccgcatccggcaagttgtattgctcaacttcgctaaatctggtgctttttcaacaacgcgcggaactgatgataagttaaccccagtaattcagccgcgcgcttctggttatatttcccttgttgcaaactgagttgcagcaactctttttcctgctgcatctgaaactcacgtaaatccagcggcagtgttggaagcgaggtggtttctgaaacggcgatagcgtcttcaggcggacgccgtttaaagggatcaataatgatgtcatcaagcggataatcgctggtgccgtggcgatacactgaacgttccaccacgtttttcaattcacgaatatttcccggccaacgataattcagcaatgtttctctggcgcgctccgtaaaccccgggaacagaggcagcttgatttcccgacacatctggatggcaaagtattctgccatcaacattatgtcgctttcgcgctcgcgcagtggtggcagttgtacaacatcaaaagccagtcggtcgagcaggtcagcgcgaaaagtgccttcattgaccatcgccgggagatcggcattcgtcgcgcataccaaccgcacattcacctgcaatggttggctgccgccaacgcgctccagttcaccgtactcaatcacgcgcaataatttctcctgcaccatcatcggtgccgtagcgagttcatcaagaaatagcgtaccgccgtcggcacgttcaaatctccctggatgacgtttttgcgcaccggtaaacgcccccgcttcgtgaccaaacagttcggaatccagcagattttcatttaacgccgcgcagttaagggaaataaacggcccttgccaacgggaggagagataatgcaggcggctggcaatcagctctttaccggtgccgcgttcgccgatgatgagcaccggtttgtccagcggtgcgagatgcgaaacctgttccagcacttcgagaaagctgttcgcctcaccaagtaaattatctttgtattctgccatgatgaaattcgccacttgttagtgtaattcgctaactcatcctggcatgttgctgttgattcttcaatcagatctttataaatcaaaaagataaaaaattggcacgcaaattgtattaacagttcagcaggacaatcctgaacgcagaaatcaagaggacaacattatgggtattttttctcgctttgccgacatcgtgaatgccaacatcaacgctctgttagagaaagcggaagatccacagaaactggttcgtctgatgatccaggagatggaagatacactggttgaagtacgttctacttcggcgcgcgcgttggcagaaaagaaacagctgactcgccgtattgaacaagcgtcggcgcgtgaggttgaatggcaggaaaaagccgaactggcgctgctgaaagagagagaggatctggcacgtgcagcgttaattgaaaaacagaaactgaccgatctgattaagtccctggaacatgaagtgacgctggtggacgatacgctggcacgcatgaagaaagagattggcgagctggaaaacaaattgagcgaaacacgcgctcgccagcaggcattgatgttacgtcatcaggcggcaaactcgtcgcgcgatgtgcgtcgtcagctggacagtggcaaactggatgaagcaatggctcgtttcgaatctttcgaacgtcgtattgaccagatggaagcggaagcagaaagccacagcttcggtaaacaaaaatcgctggacgatcagtttgccgaactgaaagccgatgatgcaatcagcgaacaactggcacaattaaaagccaaaatgaagcaagacaatcaataataacatccaggcggcgtccgaacgcgccgccgctcatcgtctaaggagtacttatgagcgcgctatttctggctattccgttaaccatttttgtgctgtttgttttaccgatctggttatggctgcattacagcaatcgttctggtcgcagtgaattgtcgcaaagtgagcagcagcgattagcgcaactggctgatgaagcaaaacggatgcgcgaacgtattcaggcgctggaatctattcttgatgcagaacatccgaactggagggatcgctaatggcgggcattaatctcaataaaaaattatggcgtattccacagcagggcatggtccgcggcgtctgcgccgggattgccaactattttgatgtaccggtaaaactggtgcgtatcctggtggtgctgtcgattttcttcggtctggcgctgtttaccctggttgcttacatcattttgtcatttgcgcttgatccaatgccggacaacatggcctttggtgagcagctaccttccagcagcgaattgctggatgaagtcgaccgtgaactggcggcaagtgaaacgcgtttacgcgagatggaacgttatgtcacttccgatactttcacgttacgtagccgtttccgtcaactgtgaggaaagttatgaatactcgctggcaacaggccgggcaaaaggtaaagcctggtttcaaattagcaggcaagctggtacttcttaccgcactgcgctatggcccggcgggtgtggcgggctgggcgataaaatcagttgctcgccgaccgctgaaaatgttgctggctgtggcgctggaaccgctgttaagtcgggctgctaataaactggcacagcgttataaaaggtgaggggagtttcgcaaaaattgttaaatctcaggcgtataatggatggcaattttcatccatagaaggacgcttacatgtttaaaaaaggcttacttgctctggcactggtgttttcactgcccgttttcgccgctgaacactggatcgatgttcgtgttccagagcagtatcagcaagagcacgttcagggggccatcaatattcccctgaaggaagtgaaagagcgcattgccaccgccgttccggataaaaacgacaccgtgaaagtgtattgcaatgccggacgccagtcagggcaagcaaaagagatccttagcgagatgggatatacccacgttgagaacgccggtggcctgaaagacatcgcaatgccgaaggtcaaaggttaaaagaattcaccatgagcggcgcttatgcgccgtttttttttctgtcacaccttatttacatccccatagattatttgcgtcagctcacaaatacgctttttccctggtaaaaaatgatttcctgcgtgactaaaacccttgtgctcaattgacagtttattttctgcggagtagtctctcgtttcatgggaccgctaccacggaaaggcaacatgaaacagaaaattacggattacctggacgaaatctacggtggaacatttaccgcaactcatttacagaaacttgtaacgcgtcttgagagtgcgaaacgattaattacacagcgacgtaaaaaacactgggatgaaagtgatgtcgtgttaattacctatgccgatcaatttcacagcaatgatttaaaaccattacccacatttaatcagttttaccatcaatggctgcaaagcattttttcacatgttcatttgttgccgttttatccatggtcatctgatgatggcttttcggtaattgattatcatcaggtcgccagtgaagcgggggagtggcaggatattcagcaactcggtgaatgcagtcatttaatgtttgattttgtctgcaaccatatgtcggcaaaaagtgaatggtttaaaaactatttacaacagcatccaggttttgaagatttttttattgccgttgacccgcaaaccgatctcagcgccgtcactcgcccgcgtgcgttaccgttattaacgccattccagatgcgcgatcattcaacgcgccatttatggaccacctttagtgacgatcaaattgacctgaattaccgtagccctgaagtgttgctggcgatggtggatgttttactctgttaccttgcgaaaggtgctgagtatgtccgcctggatgccgttggctttatgtggaaagagccgggaacaagctgcatccatctggaaaaaacacatctgattatcaaactgttacggtcgattattgataacgttgcgccaggtacagtgatcattaccgagaccaatgttccgcataaagacaacattgcttactttggcgcaggcgatgacgaagcacatatggtgtaccagttctcgctgccgccactggtgctgcatgcggtgcaaaaacagaacgttgaggcgctttgtgcgtgggcgcaaaacctgacactaccttccagcaacaccacctggtttaacttcctcgcctctcacgatggcatcgggctaaacccgctacggggcttgttgcctgaaagcgaaatattagagctggtcgaggcgttacagcaggaaggtgcattagtaaactggaaaaataatcccgacggtacacgcagtccgtatgaaataaatgtgacctatatggatgcgttaagccgccgtgagagtagcgatgaagaacgttgcgccaggtttatccttgcccatgcgattttgttaagtttccccggtgtgccagcgatatatattcaaagtattcttggctcgcgtaatgattacgcaggtgtcgaaaaactcggatataaccgtgcgattaaccgtaaaaaatatcacagtaaagagataacccgagaactgaacgatgaagctacattaaggcatgcggtatatcatgagttgtcgcgtttaattacacttcgtcgcagccataacgagtttcatccggataataattttaccattgatacgattaattcatccgtaatgcgtattccaagaagtaacgctgatggtaattgtctgactggattgtttaatgtcagtaaaaatattcagcatgtaaatattactaatctgcatggtcgggatctgattagtgaagttgatatattgggtaatgaaataacgctgcgcccctggcaggttatgtggattaaataaaaaggaacatctcatgattaaatcaaaaatcgtgctgttatcagcactggtttcatgcgccctgatttcaggctgtaaagaagaaaataaaacgaatgtatccatcgaatttatgcattcttcggtggagcaggagcgccaggccgttatcagtaaattgattgcccgttttgaaaaagaaaaccctggcatcaccgttaagcaagtgcccgtggaagaagatgcctataacactaaagtcattactctttcacgtagcggttcgctgccggaagtgatcgaaaccagccatgactacgccaaagtgatggacaaagagcagcttatcgatcgcaaagcggttgccacagtcatcagcaacgttggtgaaggcgcgttttacgatggcgtactgcgtattgtgcgtaccgaagatggtagcgcatggaccggtgttcctgtcagcgcctggattggcggtatctggtatcgcaaagatgtgctggcaaaagcggggcttgaggagccgaaaaactggcaacagctgctggacgttgcacagaaactgaatgacccggcgaataaaaaatacggcattgcgctgcctacagcagaaagcgtgttgacggaacaatccttctcccagtttgcgttatccaaccaggctaacgtctttaacgccgaaggcaaaatcacccttgatacaccagagatgatgcaggcactgacctattaccgcgaccttactgccaacactatgccgggttctaacgacatcatggaagtgaaagacgcctttatgaacggcaccgcgccgatggcgatttactccacctatatccttccggctgtgattaaagaaggcgacccgaaaaacgtcggtttcgtggtgccaaccgagaaaaactctgcggtctacggcatgttgacctcgctgaccattaccgccgggcaaaagaccgaagagacggaagcagcagaaaaatttgtcacctttatggagcaggcagacaacattgccgactgggtgatgatgtcgccaggtgctgcgctgccggtgaataaagcggtggtgactaccgccacctggaaagacaacgacgttattaaggcgctgggtgaactaccgaatcagctaatcggtgaactgccaaatattcaggtttttggcgcagtaggggataaaaactttacccgcatgggtgatgtgacgggttctggcgtggtgagttcaatggtgcataacgtcaccgtgggtaaagccgatctctctactacgctgcaagcgagccagaaaaaactggatgaactgatcgaacagcactaaacccaggacaggaatccgcaatgaacaggcttttttcaggtcgttccgatatgccctttgcgctgctgcttctcgcgcccagcttattactgctgggcggtctggtggcgtggccgatggtgtcgaatatcgaaatcagttttttacgtctgccgctcaatcccaacatcgagtcaacgtttgttggggtgagcaactatgtgcgtatcctctccgatcccggcttctggcattcgctgtggatgacggtctggtataccgcgctggtggtggcgggcagcaccgtgctcgggctggcggtggcgatgtttttcaaccgcgagttccgcctgcgcaaaaccgcgcgttcgctggtgatcctctcctacgtaacgccgtccatttcgctggtgttcgcctggaaatacatgttcaacaacggctacggcattgttaactacctcggcgtcgatcttctgcatctctatgagcaggcaccgctgtggttcgataatccgggcagtagctttgtgctggtggtgctgttcgccatctggcgctacttcccgtatgcctttatctcgtttctggcgattttgcagaccatcgacaaatcgctgtacgaagcggcagagatggatggcgctaatgcctggcaacggtttcgtatcgtcacgctgcccgcaattatgccggtcctggcgacggtggtgacactgcgcaccatctggatgttctacatgttcgcggatgtttatttgctgacgaccaaggtcgatattctcggtgtatatctctacaaaaccgcctttgcctttaatgatttaggaaaagcggcggcgatctcggtggtgctcttcatcattattttcgctgtcattctgctgaccaggaaacgggtgaacctcaatggcaacaaataaacgcacactcagtcgcatcggtttttactgcgggctggcgctgtttctcatcatcacgctgtttccattttttgtgatgctgatgacctcgttcaagggcgcgaaagaggcgatctcactgcatcctacgctgctgccgcagcagtggacgctggagcattacgtcgacatttttaacccgatgattttcccgtttgtcgactacttccgtaacagtctggtggtgtctgtggtttcatccgtggtggcggtattcctcggcattcttggggcttacgcgctttcccgcctgcgctttaaaggtcggatgaccatcaacgccagcttttacacggtgtatatgttctctggcattttgctggtggtgccgcttttcaaaatcatcaccgcgcttggcatttacgacactgagatggcgctgatcatcaccatggtgacgcaaactctgcccaccgccgtgtttatgctgaaaagctacttcgacaccatccccgatgagatcgaagaagcggcgatgatggatggcctcaaccgtctgcaaattatcttccgcatcaccgtgccgttggcgatgtccgggctgatatccgtgttcgtctactgctttatggtggcgtggaacgactatctgtttgcgtcgattttcctctccagcgccagcaatttcaccttaccggtgggcctgaacgcgctgttcagtacgccagattacatctggggacggatgatggcggcctcactggtgaccgcattgccggtggtgattatgtatgcgctttcggaacgttttattaagagtggtttgaccgccggtggcgtgaagggctaaagcggccagtttctttacaaggagttttaaatgaaaaagttagtagccacagcaccgcgtgttgctgcgctggttgagtatgaagatcgggcgattttagctaatgaagtgaagatccgcgtgcgtttcggcgcaccgaaacacggaacggaagtggtcgacttccgcgccgccagcccgtttattgatgaagactttaacggcgaatggcagatgttcactccgcgtccggcagatgcgccgcgcggcattgagtttggcaaattccagcttggcaacatggtggttggcgacattatcgagtgcggcagcgacgttaccgactacgcggtgggcgacagcgtatgcggctacggcccgctctccgagacggtcatcattaacgcagtgaataactacaagctgcgcaaaatgccgcaaggcagctcctggaaaaacgccgtctgctacgacccggcgcagtttgccatgagcggcgtgcgcgatgccaacgtgcgcgtaggggattttgtggtggtggtagggcttggcgcaatcggtcaaattgccatccaactggctaaacgcgctggcgcttctgtggtgattggcgtcgatcctatcgcccatcgctgtgatattgcccgtcgccacggcgcggatttctgccttaaccccatcggcactgatgtaggtaaagagatcaaaacgctgaccggcaagcagggtgccgatgtgattatcgaaaccagcggctacgccgacgcgctgcaatcggcgctccgcggtctggcttatggcggcaccatctcctatgtcgcgtttgccaagccgtttgccgaaggttttaacctcggacgcgaagcgcatttcaataacgccaaaattgtcttctctcgcgcgtgcagcgaaccgaacccggattatccgcgctggagccgcaagcgtattgaagaaacctgttgggaactgctgatgaacggttatctcaattgcgaagatttaatcgacccggtggtgacctttgccaatagcccggaaagctatatgcagtatgtcgaccagcatccggaacagagcatcaaaatgggcgttacgttttaattcaaaggaatgaaaaaaatgaaaatcggcacacagaatcaggcgttctttccggaaaacattctggagaaatttcgttatatcaaagagatgggcttcgatggttttgagattgacggcaaactgctggttaacaacatcgaagaagtcaaagcggcgatcaaagaaaccggtttaccggtgaccaccgcctgcggtggctatgacggatggattggcgactttatcgaagagcgtcgtcttaatggcttaaagcagatcgagcgcattctcgaagcgctggcagaagtgggcggtaaaggcatcgtcgttccggctgcgtggggcatgtttaccttccgcttaccgccgatgacctcgccgcgtagcctggacggcgaccgcaaaatggtgagtgattccctgcgcgtactggaacaggtcgccgcgcgtaccggaaccgtggtgtatctcgaaccgttaaaccgctatcaggatcatatgatcaacaccctcgccgatgcccgccgttacatcgtcgaaaacgatcttaaacatgtacagattatcggcgatttctatcacatgaatatcgaagaagataacctggcgcaggcgctgcatgacaaccgcgacctgctcggtcatgtgcatattgcggataaccatcgctaccagccgggcagcggcaccctggatttccacgcgctgtttgaacagctgcgcgcggataactatcagggctatgtagtgtacgaagggcgtatccgggcggaagatcctgcccaggcgtaccgtgattcgttggcctggttgcgtacctgctaagaggtctttgtgaaaagtgcaatgacaagctctccgctgcgggtcgcgataataggcgcaggccaggtggcggataaggttcatgcttcgtactactgcacccgcaacgatctggaactggtggctgtctgtgacagccgcctttcccaggcgcaggcgctggcagaaaaatacgggaatgcatccgtgtgggacgatccgcaggccatgctgctggcggtgaaacctgatgtggttagcgtctgctcacctaaccgttttcattacgaacataccctgatggcactggaagcgggctgccatgtgatgtgcgaaaaaccgcccgccatgacgccagaacaggcgcgggaaatgtgcgataccgcgcgcaaactgggcaaggtgctggcctacgactttcaccatcgttttgcgctcgatacgcaacagctgcgtgaacaggtgaccaacggcgttttgggagagatttacgttaccaccgcccgcgccctgcgtcgctgcggcgttcccggctggggtgtctttaccaataaagaactgcagggtggtggcccgctgatcgacatcggcattcatatgctggatgctgcgatgtatgtgctgggctttccggcggtgaaaagcgtgaatgcgcatagctttcaaaagatcggcacgcaaaagagctgtggtcaatttggtgagtgggatccggcaacttacagcgtcgaagattcgctgtttggcaccattgaatttcataacggcggcattctgtggctggaaacgtcatttgcactcaacatccgcgaacagtcgattatgaacgtcagcttttgtggtgataaagctggtgcgacgctgtttccagcacatatctacaccgataacaacggtgaattaatgacgctgatgcaacgggaaatagcagacgacaaccgccatttgcgcagcatggaagcctttatcaatcacgtacagggcaagcccgtgatgatagccgacgccgagcaggggtacatcatccagcaactggtggcggcgttgtatcaatccgcagaaacagggacgcgtgtggaattatgaccaggccagtaacgttatcagaaccccatttcagccagcataccctgaacaagtatgcatcgctgatggcgcaggggaacggctatcttgggcttcgcgccagccatgaagaagattacacgcgccagacgcgagggatgtatctggcggggctgtatcatcgggcgggaaaaggtgaaatcaacgaactggtgaacctgcctgatgtcgtggggatggagattgccataaatggtgaggttttctcgttatcccacgaagcctggcagcgtgagcttgactttgccagtggcgaattacgccgcaatgttgtctggcgtaccagcaacggctcaggttacaccatcgccagccgtcgctttgtttcggcagaccaactgccgctcattgcgctggaaatcactattacgccactggacgccgacgcgtcagtgctgatttcaacaggcattgacgccacgcaaaccaatcacggtcgccaacatctcgacgaaacccaggtgcgggtgtttggtcagcatctgatgcaggggagctacaccacccaggatggacgcagtgatgtggccatcagctgttgctgtaaggtgagcggtgatgtgcagcaatgctataccgccaaagagcgccgtttactgcaacataccagtgcgcagcttcatgcaggcgagacaatgacgttgcaaaaactggtgtggatcgactggcgggatgacaggcaagctgctttagacgagtggggcagcgcgtcgcttcgccagcttgaaatgtgcgcgcagcagagttacgaccaacttcttgcagcatcaacagaaaactggcgtcaatggtggcagaaacgtcgtatcacggtaaatggcggcgaagcgcacgatcagcaagcgttagattatgcgctttatcatctgcgcatcatgacgcctgcccacgacgagcgcagcagcattgcggcaaaaggcttaaccggcgaaggctacaaaggccacgttttctgggatacagaagtatttttgttaccgtttcatctgtttagcgatccgacggttgcccgaagtttactgcgttatcgctggcacaacttgccaggcgcgcaggagaaagcgcgacgcaacggctggcagggcgcgctatttccgtgggaaagcgcgcgcagcggcgaagaagagacgccggaatttgccgccattaacattcgcaccgggctgcggcaaaaagtggcctcggcgcaggcggaacatcatctggtggccgatatcgcctgggcggttattcaatactggcagaccacgggggatgaaagtttcattgcgcatgaaggcatggcgctacttctggagacggcaaagttctggattagccgcgcggtgagagttaacgatcgtctggaaattcatgatgttattgggccagacgaatataccgaacatgtcaataataatgcatacaccagctatatggcccgctacaacgttcaacaggcgctgaatattgcccgccagttcggctgtagcgacgatgcgtttatccatcgcgccgaaatgttcctcaaagagctatggatgccagaaattcagcccgacggcgttttgccgcaggatgattcgtttatggctaagccggcgattaatctggcgaaatacaaagcggcggcggggaagcaaaccatactgctggattattcacgcgcagaagtgaacgagatgcagatcctcaaacaagctgatgtggtgatgctcaattacatgctgccggagcagttctcagcggcatcgtgtcttgccaatctgcaattttatgaaccgcgcactattcacgactcgtcattaagtaaagcaatccacggcattgttgccgcacgctgtggcctgctgacccaaagttatcagttctggcgcgaggggactgaaatcgatcttggtgctgatccgcatagttgtgatgatggtatccatgctgccgcaactggcgctatctggctgggggcgattcagggttttgccggggtgagcgtgcgtgacggtgaattgcatctcaatccggcgttacctgagcagtggcaacagttgtctttccctctgttctggcagggctgcgaattacaggtcactcttgacgcgcagcgtattgcgattcgaacttctgcgcccgtttcactgcgtttgaacggtcagcttataaccgtggctgaagaatctgttttctgtttgggtgattttattttgcccttcaatgggaccgctaccaaacatcaggaggatgaatgaaactgcaaggggtaattttcgatctggatggtgtaatcaccgataccgcgcatctgcatttccaggcgtggcagcagattgccgctgaaattggcatcagcattgatgcgcagtttaacgaatccctaaaagggatcagccgcgatgagtctctgcggcgcattctgcaacacgggggcaaagagggcgactttaactcgcaggagagggcgcaactggcgtatcgcaaaaatctgctctatgtccactcactacgcgagttgacggtcaacgctgttctacccggcattcgctctttgctggcagatctccgtgcacagcagatctcggttgggctggcttctgtctccctgaatgcgccgacgattttagcggcgctggagctgcgcgagtttttcaccttctgcgcggatgcttcccaacttaaaaactcgaaaccggacccggaaatctttctcgccgcctgtgcagggctgggcgtgccgccgcaggcatgtatcggcattgaagatgcgcaggcgggcattgacgccattaacgccagcggtatgcgctcggtggggatcggcgcgggcttaaccggggcgcaattactgttgccttcaacggaatcactcacctggccgcggttatcggccttctggcaaaacgtatagcaaaggaatcaacatggctcagctttcgttacaacatattcaaaaaatctacgataaccaggtgcatgtggtgaaggacttcaacctggaaattgccgataaagagttcatcgtgtttgtcggcccgtcgggctgcggtaagtcgaccaccctgcgcatgattgccgggcttgaggagatcagcggcggcgatctgttgatcgacggcaaacgaatgaatgacgttccagccaaagcacgcaatatagcgatggtgttccagaactacgcgttgtatccgcatatgacggtttacgacaacatggcgtttggtctgaagatgcaaaaaatcgccaaagaggtgattgatgagcgggtgaactgggcggcgcaaattctcggcctgcgtgagtacctgaaacgtaagccgggggcgctttccggcgggcaacgtcagcgagtggcgcttgggcgggcgattgtacgcgaagcgggcgtgtttttaatggatgaaccgctctctaaccttgatgccaagctgcgcgtgcaaatgcgcgcagagatcagcaagctgcatcagaaactgaacaccaccatgatctacgtgacccacgatcagaccgaagcgatgaccatggcgacgcggattgtgattatgaaagacgggattgttcagcaagtaggtgcgccgaaaaccgtttataaccaacccgcgaatatgtttgtttccggatttattggatcaccagcgatgaattttattcgcggcacgatcgatggcgataaattcgttacggaaacgcttaaattaaccattcccgaagagaaattagcggttctgaaaacacaggaaagtttgcataagcccatcgtgatgggaatacgaccggaagatattcatccggacgcgcaagaggaaaataacatttccgccaaaattagcgtggcagaattaaccggtgcggaatttatgctctacaccacggttgggggcacgagttagtggtccgtgctggtgcgttaaatgattatcatgcaggagaaaatatcactattcattttgatatgacgaaatgtcatttctttgatgcagaaacggaaatagcaattcgctaaatacagggggaaggcattcccccaggataatacaaggaacaataatgaaaaagttattaccctgtaccgcactggtgatgtgtgcgggaatggcctgcgcacaggccgaggaaaggaacgactggcactttaatatcggcgcgatgtacgaaatagaaaacgtcgagggttatggcgaagatatggatgggctggcggagccttcagtctattttaatgccgccaacgggccgtggagaattgctctggcctattatcaggaagggccggtagattatagcgcgggtaaacgtggaacgtggtttgatcgcccggagctggaggtgcattatcagttcctcgaaaacgatgatttcagtttcggcctgaccggcggtttccgtaattatggttatcactacgttgatgaaccgggtaaagacacggcgaatatgcagcgctggaaaatcgcgccagactgggatgtgaaactgactgacgatttacgtttcaacggttggttgtcgatgtataaatttgccaacgatctgaacactaccggttacgctgatacccgtgtcgaaacggaaacaggtctgcaatataccttcaacgaaacggttgccttgcgagtgaactattatctcgagcgcggcttcaatatggacgacagccgcaataacggtgagttttccacgcaagaaattcgcgcctatttgccgctgacgctcggcaaccactcggtgacgccgtatacgcgcattgggctggatcgctggagtaactgggactggcaggatgatattgaacgtgaaggccatgattttaaccgtgtaggtttattttacggttatgatttccagaacggactttccgtttcgctggaatacgcgtttgagtggcaggatcacgacgaaggcgacagtgataaattccattatgcaggtgtcggcgtaaattactcgttctgataatgggctaaattgccggatgcggcgcgagtactttatccgatctataaatgtaggccggataagatgcgctagcatcgcatctggcattcaggcaaggtagctggtatttatttcagcgtcatatgcgtggcaacggtaatattctgtggtgacggttttccagaaattaagcggaataataactcgcagctttgttgacctaactcctgcgtcggaacatcgatgccgcccggtgcaggcgttaaaataaatgacagcgtttcattgctataacccaccaccgctaactgctgcggaatagcaatatttttctctgctgccgcacgataaatgctcattaatttcaggctgtcagtggcaaacaccgcctcaggcaacggtgactggcttaataattgccgtgctgcttttaatgcagtttcatgggtataaccgccatcaacaatccattcatcacgcactgcaatattatgcgcagccaggctctgcttataaccattaacgcgatcaaccgaaacatggacatcaagcggagcatgcaggcaggcaatattttgatgcccactttcaattaatgcatcggtcaacgcaatgctgtcgccaaaattatcggtatcgacagaataaacatgggcatattgaccttcaactttgccaatcaccaccaccggaatatcatatttatcgagttgggcaaaaaatgactcatccgctggcgaactgagcataataatgcctttaatcattttctgcttaattttgctttcgcatttttgcagatcttctgccggattgtgcgacgtttgtaatatcacgtcgaaaccttcttcttcagctttggcggtgatggcatgcaaaacttcagagaaaaacggattacccgccgtagttttggtcgaacgggtagaaatcaccataatggcatcaaaacccgaagaggtcagcgcgcgggccagcttgtttggctgatactgtaattcttcaatggcccgtaacactttttcgcgcgcttccggggagatattagtttgcttattcagcacgcgtgatacggtggattttgatacgcctgcaaccctggcaatatcataaatagtaggggacataggtcaggaactccgtccgaacgtgaatgctgcacatcttatggagttcgccggtcgatgacaacacgggcagttgataatcaatggcctggcccccacattcatatccttacgaatgattttttttctggtcttcagagcagcacaggacagcaatgaagcgacttaaaaatgaactcaatgcgctggtgaatcggggtgtcgacagacatctgcgcctcgctgtaaccggacttagccgcagcggcaaaacagcgtttatcaccgcgatggttaatcagttgcttaatattcacgccggagcacgtttgccgctgttaagtgcggtgcgtgaagagcgcctgctgggcgtgaaacgcattccccagcgtgactttggcattccgcgcttcacctatgacgaagggctggcgcagttatatggcgatccacccgcctggccaacgccaacgcgcggcgtcagtgaaatccgcctggcgctacgttttaaatcgaatgattcgctgctacgccactttaaggatacctccacgctgtatctggaaattgtggattatcccggcgaatggttgctcgacctgccgatgctggcgcaggactatttaagctggtcgcgccagatgacgggcttactcaatggtcagcgcggagaatggtcggcgaaatggcgaatgatgagcgaagggctggacccgctagcgcctgccgacgaaaaccggctggcggacattgccgccgcgtggaccgattatctccaccactgtaaagagcaggggctgcactttattcagcctgggcgctttgtcttgccgggagatatggcaggtgcgcccgcgctgcaattcttcccgtggccggatgtcgatacctggggcgagtccaaactggcgcaggccgataagcataccaatgccggaatgctgcgcgagcgctttaattattactgcgagaaggtggtgaaggggttctataagaatcattttctgcgctttgaccgccagattgtgctggtggattgcctgcaacctctcaacagtgggccacaggcatttaatgatatgcgtctggcactgacgcagctgatgcaaagttttcactacgggcagcgtaccctgttccggcgtttgttttcgccggttatcgataagctattgtttgctgccactaaagcggaccatgtgaccatcgatcagcacgctaatatggtttcattactgcaacaactgattcaggatgcctggcaaaatgcggcgttcgaagggatcagcatggactgcctggggctggcgtcagttcaggcgaccaccagcggcattattgatgttaacggtgagaaaatcccggcgctgcgtggtaatcgacttagcgatggcgcaccgctcactgtttatcctggcgaagttcccgcacgtttgcctggtcaggcgttctgggataagcaaggcttccagtttgaggcatttcgtccgcaggtgatggatgtcgacaaaccactaccgcatattcgtcttgatgctgcgctggaatttttaataggagataaattgcgatgaccgaaccgttaaaaccacgtattgatttcgacggtcctctggaggtcgatcagaatcctaaattcagggcgcagcagacctttgacgaaaatcaggcgcaaaattttgccccggccacgctcgacgaagcgcaggaagaagaggggcaagtcgaagcggtaatggacgcagcgttacgtccgaaacgcagcctgtggcgcaaaatggtgatgggagggctggctctgtttggcgcaagcgttgtcgggcagggtgtacagtggacaatgaatgcctggcaaacccaggactgggtggcgctgggtggatgtgccgctggggcattgattatcggcgctggcgtaggttctgtggtaacagagtggcggcgcttatggcgcttgcgacagcgcgcccatgaacgcgacgaagcgcgtgatttattgcatagccacggcacgggcaaaggccgcgcattttgcgaaaaactggcgcagcaggcgggtattgatcagtcgcatccggcgctgcaacgctggtatgcctcaatccatgaaacgcaaaacgaccgtgaagtggtcagcctgtatgcgcatttggtccagccagttttagatgcccaggcgcggcgcgaaatcagccgttcggcggcggaatcaacgttgatgattgcggtcagcccgctggcgttggtcgatatggcgtttatcgcctggcgcaatctgcgtttaattaatcgcatcgccacgctgtatggcattgaactggggtattacagccgtttgcgtctgtttaagctggtattgctgaatatcgcttttgccggagccagcgaactggtgcgcgaagtggggatggactggatgtcgcaagatctcgctgctcgtttgtctacccgcgcagctcaggggattggtgcaggacttctgacggcacgactcgggattaaagctatggagctttgccgcccgctgccgtggattgacgatgacaaacctcgcctcggggatttccgtcgtcagcttatcggtcaggtgaaagaaacgctgcaaaaaggcaaaacgcccagcgaaaaataatgcaatatcgggtgctgaccggatatctttacgccgaagtgcccgtttttccgtctttgtgtcaatgattgttgacagaaaccttcctgctatccaaatagtgtcatatcatcatattaattgttcttttttcaggtgaaggttcccatgcgtctggaagtcttttgtgaagaccgactcggtctgacccgcgaattactcgatctactcgtgctaagaggcattgatttacgcggtattgagattgatcccattgggcgaatctacctcaattttgctgaactggagtttgagagtttcagcagtctgatggccgaaatacgccgtattgcgggtgttaccgatgtgcgtactgtcccgtggatgccttccgaacgtgagcatctggcgttgagcgcgttactggaggcgttgcctgaacctgtgctctctgtcgatatgaaaagcaaagtggatatggcgaacccggcgagctgtcagctttttgggcaaaaattggatcgcctgcgcaaccataccgccgcacaattgattaacggctttaattttttacgttggctggaaagcgaaccgcaagattcgcataacgagcatgtcgttattaatgggcagaatttcctgatggagattacgcctgtttatcttcaggatgaaaatgatcaacacgtcctgaccggtgcggtggtgatgttgcgatcaacgattcgtatgggccgccagttgcaaaatgtcgccgcccaggacgtcagcgccttcagtcaaattgtcgccgtcagcccgaaaatgaagcatgttgtcgaacaggcgcagaaactggcgatgctaagcgcgccgctgctgattacgggtgacacaggtacaggtaaagatctctttgcctacgcctgccatcaggcaagccccagagcgggcaaaccttacctggcgctgaactgtgcgtctataccggaagatgcggtcgagagtgaactgtttggtcatgctccggaagggaagaaaggattctttgagcaggcgaacggtggttcggtgctgttggatgaaataggggaaatgtcaccacggatgcaggcgaaattactgcgtttccttaatgatggcactttccgtcgggttggcgaagaccatgaggtgcatgtcgatgtgcgggtgatttgcgctacgcagaagaatctggtcgaactggtgcaaaaaggcatgttccgtgaagatctctattatcgtctgaacgtgttgacgctcaatctgccgccgctacgtgactgtccgcaggacatcatgccgttaactgagctgttcgtcgcccgctttgccgacgagcagggcgtgccgcgtccgaaactggccgctgacctgaatactgtacttacgcgttatgcgtggccgggaaatgtgcggcagttaaagaacgctatctatcgcgcactgacacaactggacggttatgagctgcgtccacaggatattttgttgccggattatgacgccgcaacggtagccgtgggcgaagatgcgatggaaggttcgctggacgaaatcaccagccgttttgaacgctcggtattaacccagctttatcgcaattatcccagcacgcgcaaactggcaaaacgtctcggcgtttcacataccgcgattgccaataagttgcgggaatatggtctgagtcagaagaagaacgaagagtaagcgcgaatatgcctgatggtgcaacaccatcaggcatattaaattatgctttcagtacagccagagctgcttcgtaatccggctcggtggtgatttcatccaccagctggctgaaaatcacattgtcattttcgtcaataaccacaacggcacgcgctgccagacctttcagtgggccatcagcaattgccacaccgtaagcttgcagaaattcagcgttacggaaagtggagagggtgataacgttgttcagaccttctgcgccgcagaaacgagactgggcgaacggcagatcggcagagatacacagcacaacggtgttgtcgatctcagttgccagttggttaaacttacgtactgatgcggcgcaaacaccggtatcaatactcgggaaaatgttcagcactttgcgtttacccgcaaactgaccgagggtgacgtcagacagatcttttgccacgagagtaaaagtctgcgctttgctacccgcctgcgggatggaattggcgactgtaaccgggttgccctggaaatgaacggtttgtgacatgattatctttcctgtttacatatagttaacgtcacacctagtttatgctaactgtcaataacacagcaaacgctatttgcgcttaatccgcagaccaccgcgacaacaaggagtaaagatgagaaccgttaaggtattcgaggaagcctggcccttacataccccgtttgtgattgcccggggaagtcgcagtgaagcgcgcgtggtggtggttgaactggaagaagagggtattaaaggcaccggcgaatgcacgccgtatccgcgttatggggaaagtgatgcctcggtaatggcgcaaattatgagcgtcgtgccgcaactagagaaagggctgacacgggaggagttgcaaaaaattctccctgccggcgcagcacgtaatgcgctggattgtgcattgtgggatctggccgcgcgaagacagcagcaatcgctggctgatttgatcggcataacgcttcccgagacagttatcactgcacagacggttgtcatcggtacgcctgatcagatggccaatagtgcatcaacactctggcaggcaggcgcgaaattactgaaagtgaagctggataaccatcttatcagtgagcggatggtggcaattcgcacagctgtgcccgatgcgacgctgatcgttgatgcaaatgaatcctggcgtgcagaagggttggcggcgcgttgccagctattggcggatttaggcgttgcgatgcttgaacaaccgcttcctgcgcaggacgatgcggcgctggagaattttattcatccgttgccgatttgtgctgatgaaagttgtcatactcgtagcaatttgaaggcgctgaaagggcgctatgagatggttaatattaagctcgataaaaccgggggtctgacggaagcgctggcgctggcgactgaagcgcgtgcacaaggtttcagtctgatgctgggctgcatgttgtgtacctctcgtgccattagcgccgctttaccgctggtgccgcaggtcagtttcgccgatcttgacggaccgacctggctggcggtagatgtggaaccggcgcttcagttcacgacgggcgaattgcatctttaggatgccagcgcagcaagtttgccatcgcaaagagatatttttcgctggcttcgtcggaggagatgggcggaaactctgcggtgatgcaatgcaagttcagatctgcacaccaactgccgaaagagccaggcgtttcataaccgacgctggttaccagaggcaattcaaacgcctgagccagccattcgcctaattcgctgtgtctgggatcttcaatacaggccagtggatcgtggaatgagaccacccaggcaggttgaatgcggtgtataagctggcacagcgcctgggtttcaggttcggagccaggtttgtcacctgtcagtaatacgacatcgcgttcttcagcggcgctgttccagcgataaacggtttcaccttccttccagttcgccgccggaaagtttctgtttaaatccacaccattagcattggcccgtaaccccaactggcagccgtcaggattcacacacagcaccacatgatgacggcgcaaagaaggtgtcaacgtccgcagagcacaggagagcgtgacgaccgaagagttttcatcaccgtgagtgccagccagaatcaaaccactttcgcggctggctgcaggggcaggaaaccagattaacggcgcgcccaataatgaacgtccgtaatgttctgttccgggcggaaatgcgccgcgttcggcgcgtgggcgggttacggtcatgatcgtctctggttcaggaagtattacaggcagtgttgtgcaaattttgcggattatcaaatccttttcttcaacgctatgtcatcgatcttgtatcacttttttgccggaagttgtttgcattttattagttggatagggtttgtggatttttgctggctgacgggcaaataaagtttgtttaatggtttgcttatctgccagttgattaatcacatggcgggctatctgaccgccagcaccaagaatcagtacatttttcatgaaaattatcccagattattggcagcaatatgccagtccatatcactattgcggatttgaatatgtttcattacagagtttcctcaaagaacggagctaatactgaaattgcttcagccacataggctttgccgtcataaagatccatatggtttgcgccttcaacaatgtgatagcgtttatcctggcttgatgctcgatcgtacaggtcgtcactcatccatttgctccctgcctggctgcccgccacaatctgcgtcggctgagtcaggtacacttccgccatatggtaagcatcataggtaataatctggttaaggctgcgcaaagtagcgtaacccggtgctgttggatactgcgcgcgaggggtgtggtaatactcccaggcctgacgcagttcttcgttcggcgcatcggactccttcattggtgccagtggcataatggcgtattctccgctgctaatatcgctggttctggcgtttgaacccgcttcaacgtatggcagggcatcaatagatttcacattgttttcccaaccattacggaatatcgaaccaatattgaccgcactaacggtaccgatggccttgatgcggcgatcctgaattgcagcattggctgtatatcctgcaccggcacaaattcccatcgcaccaattcgggtattgtcgacataagaaagcgttgtcaggtaatcaatcacggcactgatgtcttcagtacgaatgtatgggttttctaactgacgcggctcgccgccactttcaccttgataagatgcgtcataagcaatagtgacaaatcccttttccgccagttttttggcataggttccggccgtttgttctttaacgcccccacctgggtgagataacacaattgcctgatactgacgggtttcatcaaattttggagggaaatagatcactgcagacaaagagatggttggattattgctgttagtgaagctgactttattattcatcattccgttcctcatggagttgtcggttcgttttaacggttggtgatatcactatagatattgatcattaagttgattagacccaaaatcatgattagacctatcatttaaatgattaatagattgcatggagatactgaatgaagcgtgaagaaatcgctgatctgatggcgtttgtcgtcgttgcagaggagcgtagcttcactcgtgcagcagcccgcctgagcatggcgcagtcagctttaagccagatagtgcgtcgtatagaagaacgattgggattgcggcttctgacgcgaaccacgcgcagcgttgttccaactgaagcgggcgagcatcttttgtctgttcttggccctatgttgcatgacatagattcagccatggcatccctgagcgatctgcagaaccgcccatccgggacaatacgtattactactgtagaacatgcagcaaaaacgatattgttaccagcaatgcgcacattcctgaaatcgcatcctgaaattgatattcagctcaccattgattatggtttgaccgatgtcgtttctgaacgttttgatgcaggcgtccgtctgggtggggagatggataaagatatgatcgccattcgaatcgggccagatataccaatggctattgttggctcaccggattatttttctcgccgaagtgttccaacgtcagtgtcacaattaatagatcatcaggcaattaatttgtatcttcccacatcgggtacagcaaatcgctggagattaatacgcggtggacgtgaagttcgtgttcgcatggaaggtcagcttttactgaatacgatagacctgatcattgatgctgcaattgatgggcatggattggcgtatctaccttatgatcaggttgagcgggctattaaagaaaaaaaactgatacgtgttttggataaattcacaccagatttacccggttatcacctgtactatccacaccgtcgacatgctggctcggcattctcattatttatagataggctgaagtataaaggtgctgtttagcactacttgctgatacattaatttaattcttctcttaacgtattctcagttcctttcaacgttttggtcattttttattcttcgtacaatggcgacagatgctgattatgataccgaaaacgggtttgaacgtgcgaagcccgaacgtagtgttcggagttctatgtgctttaccgcattttggagactattatttacactaaatctgatttgatatattgatacttaaaacatttgatgcttcctttgtcacttttttgatggaagttgtttgcatttctttaaggcgaaacaaataattacgcatcaattttaatgtcggttagagggaaacttatgaagcactctgtttcagtcacgtgttgtgcgctgttggtcagcagcatttctctttcgtatgctgcagaagttccgagcggcacagtactggcagagaagcaggagctggtgcgccacattaaagatgagcctgcgtcgctggatcccgctaaagccgtgggcctgccagagattcaggtcattcgcgatctgtttgaaggtctggtgaatcagaacgaaaaaggggagattgtccccggcgttgcgactcagtggaaaagtaatgacaaccgtatctggacttttaccctgcgcgataacgcaaaatgggcggatggcacaccggtaacggcgcaagattttgtctacagctggcaacgtctggtggacccaaaaacattgtcgccatttgcatggtttgccgcgctggcgggaatcaacaacgcacaggcgattattgatggtaaagctacgcctgaccagcttggcgtcaccgcagttgatgcccatactttgaaaattcagcttgataaaccgttgccgtggtttgtgaatttaaccgctaactttgccttcttcccggtgcaaaaagccaacgtagaaagcggtaaagagtggacgaaacccggaaatctgatcggcaatggcgcttatgttcttaaagagcgcgtagtcaatgaaaaactggtcgtggtaccgaatacccattattgggataacgccaaaacggtactgcaaaaagtgaccttcctgccaattaatcaggaatccgcagccactaagcgttacctcgcgggggatattgatatcaccgaatccttcccgaaaaatatgtatcagaagctgttgaaggatattccggggcaggtttatacgccgccgcagctcgggacctattattatgcgtttaacacgcaaaaagggccgacggcagatcagcgcgttcgtctggcattaagtatgacgatagatcgccgcctgatgaccgaaaaagtattagggacgggcgaaaagccagcgtggcattttacaccagatgttaccgcgggatttacgccggaaccttcgccgtttgaacaaatgagtcaggaagaactgaatgcgcaggcaaaaactttgttgagcgcagctggttatggtccgcaaaaaccgctgaagctgacgcttttgtataacacttcagaaaaccatcaaaaaattgcgattgctgtagcatcgatgtggaaaaagaaccttggcgtagatgttaaattgcaaaatcaggaatggaaaacctatatcgatagccgtaacaccggcaattttgatgttatccgcgcctcgtgggtgggggattataatgaaccctccactttcctgacattattaacgtcaacgcattcaggaaatatttcacgctttaacaatccggcatatgacaaagttctggcccaggcatcgacggaaaataccgttaaagcgcgtaatgccgattacaacgcggcagaaaaaatcctcatggagcaagcaccgattgcaccaatttatcaatataccaatggacgattaatcaagccgtggctgaaaggttatcccattaataatcctgaagatgtggcgtacagtcggactatgtatattgtgaagcattgatgtgatgggaactggcgttacccttgtgcataacgccagtgatgtctgatttagcgaccctgttccggcggtgtaatgttatccatatacagcgtctggctggggaaggcaaagtccgcgccgtgtgactgtacaatatcgataatcttcaaataaacgtcttgctgtgcagcaagccattcagcccataccgtggttttggtaaagcaataaaccataatattcaatgaagagtcagcaaactggttgaaataaaccagtaaggtttgtcgctggtcgatggccgggtgatttttcagcatctcacgtacagcttcgacaataacgcccacttttgccgcatcctcataacgtaaaccaatggtcgtggtaatgcggcggttggtcattcgtcctgggttttctacgctgatcgacgaaaacagcgagttcggtacgtacaatggacgattatcaaaggtcgtaattttggtaattcgccagccaatttccgctactgtaccttcgatatttctgtccggtgaacggatccagtcgccaatactgaaaggacggtcgaaatagagcataatcccggaaaagaagttactcagaatatctttaccggccataccgacagccagaccaccaataccaccaaaggtcagcaagccagaaaggctcatgccgaaatgttcgccataaagcagaacaagcaccacaataatggtgattttgatgatacgcgacataatccgcgcactggtgatatcgcgaccttttttaatctgctgtttttcaaactgattaatcagcagaaatagcttaatcgtcagaataaccgcaatcagggacgtacagataaaatcgataacgcctggggtgataaatttgagtttatagttttctataacataattaataatgctaccaacagcactgataattatggtgtagattaaaaattgcaccgcatggaataaaaatccttttcttttacgatttccacggcgaaaccaaaagctcatcagaatcaatgctgcgcagctaccgaaaataatgaccagattaagcgcattatttgtaaacagttcagcgatcattgttttatcaggctcctccagataattgtcgtcatgccggaaacccctggcggggctattttaccgcgacaattcattcagatcatcaatagtcagggaaggaagtagcaacattagctaaggaaggtgcgaacaagtccctgatatgagatcatgtttgtcatctggagccatagaacagggttcatcatgagtcatcaacttaccttcgccgacagtgaattcagcagtaagcgccgtcagaccagaaaagagattttcttgtcccgcatggagcagattctgccatggcaaaacatggtggaagtcatcgagccgttttaccccaaggctggtaatggccggcgaccttatccgctggaaaccatgctacgcattcactgcatgcagcattggtacaacctgagcgatggcgcgatggaagatgctctgtacgaaatcgcctccatgcgtctgtttgcccggttatccctggatagcgccttgccggaccgcaccaccatcatgaatttccgccacctgctggagcagcatcaactggcccgccaattgttcaagaccatcaatcgctggctggccgaagcaggcgtcatgatgactcaaggcaccttggtcgatgccaccatcattgaggcacccagctcgaccaagaacaaagagcagcaacgcgatccggagatgcatcagaccaagaaaggcaatcagtggcactttggcatgaaggcccacattggtgtcgatgccaagagtggcctgacccacagcctggtcaccaccgcggccaacgagcatgacctcaatcagctgggtaatctgctgcatggagaggagcaatttgtctcagccgatgccggctaccaaggggcgccacagcgcgaggagctggccgaggtggatgtggactggctgatcgccgagcgccccggcaaggtaagaaccttgaaacagcatccacgcaagaacaaaacggccatcaacatcgaatacatgaaagccagcatccgggccagggtggagcacccatttcgcatcatcaagcgacagttcggcttcgtgaaagccagatacaaggggttgctgaaaaacgataaccaactggcgatgttattcacgctggccaacctgtttcgggcggaccaaatgatacgtcagtgggagagatctcactaaaaactggggataacgccttaaatggcgaagaaacggtctaaataggctgattcaaggcatttacgggagaaaaaatcggctcaaacatgaagaaatgaaatgactgagtcagccgagaagaatttccccgcttattcgcaccttccctaactaatcaatgcgttgattgtaaatccagctaagaggtgaggttttcagagcagacaacggtgaaatgtcatggtattgttacgtttaggtaacaagaaatttgtctgcacaaggattacatcatgattatggcgaaactgaagtcagcgaaagggaagaaatttctctttggtttgttggcggttttcattattgcggcgtcggttgtgactcgcgcgaccatcggcggcgttatagaacagtacaatattccgctgtctgagtggacgacatcaatgtatgtgattcagtcatcgatgatttttgtttatagcctggtctttactgtgttgctggcaatcccgttgggaatttatttccttggcggcgaagagcagtaagtaaaaaataggcccgataactcgggccttgtcagttattgaagagtcgttaatcgtcttcttcgtcatccagttcaacgggtgtctgatactggtcaggtttaatgaccagcaggtcgcagcgaagatgatcaatcacctgttccgccgtgttgccgaggaatgctgctgaaataccggtgcgtcctaccgtgcccagaaccacaatccccgcctgtaagtgctccgccaaatcaggaatcacctcttctggcagacctttttctacgtgcgtcatgttttcattaatgccgaatttctgccgcagggctttcattgccagcaaatgttgcccacgaatggcatcgttataaacgctcgggtcaaattccggcagttcaatcgcgatattaattggcgttaccggataagcgccaaccagatgaacttcggtatggttgacttgttctgccagttcgatcgtctctttgaccagtttttcattgagcgcattatgatacggctcttcactggcgagattcaccgccaccagcgccttgcctccttccggccacggctggtctttcaccatccacaccgggcttgggcatttgcgtaacagatgccagtccgttggcgtaaaaatcaccgcttccagacggtcatgttggtgcgccatttttagcaccaaatcgtgtccgccgctgatcacttcctgaatgatggcttcgaaaggacggttatgccagaccactttaatttcaatgggaacgccagcattgagataatattttgcctgctcgtggatccaggctgtacgctggctgatgacgccctgacgcatagcggtacgttcgtccggggagagcagggtggtcatttcgtatgagaagtcatagatcggcaaaaaggctttaattttgccaccaatccgttgatgtaaataaacagctcgccgcaatgctggttggtcgtcctggttaggatcgataacaacgagcatgttctgatacatagccatacagggtctccttacaacaactgtcaacgcagtttgtaattaaaagattaacccatatctggtgaatgaaacagtgatgaaccttctgccagatcaataaatcagaaaaatttaatgatatgacagaaggatagtgagttatgcggaaaaatcaggcaacgttacgcgtatgaccagcaagctgggccagcgcatcgttattttcgatggtgatgtatttacctttgactgccagcatgccgcttttctggaagcgacccagcagacggctgatggtttctaccgtcaggcccagatagttaccgatatcgccacgagtcatcgtcaggcggaattcacgaggggagaagccgcgttgggcaaaacgacgggacaggttgtagatgaatgcagccagacgttcctcggcatttttcttcgacaacagcaggatcatgtcctgatcgcctttgatttcaccgctcatcagacgcatcatctgctgacgcagattcggcattttaccggacaaatcgtccagcgtttcgaacgggatttcacataccatcgaggtttccagcgcctgcgcgaagctcgggtgatggccgctgccgatggcgtcaaatcccaccaggtcgcctgctaaatggaaaccagtgatttgctcgtcgccttgctcagtgatggtataacttttaatcgtaccggagcggatggcataaagcgatttaagttcatcaccagccttaaacagcgtctggcctttctgaataggcttcttccgctcaatgatattatcaagctgatcaagctcatgttcgttgagtgtgaacgggatgcaaagctggctgatgctgcaatcctggcaatggatagcacaaccgccagactgaatgcgccgtataattcgcttttccgggatcataggtctgctcaagccgtaattgatatttgtcaattttaacatctttttagggagcaagtaagtctaagcaaaccttaacagcagagaattccgatattagatgtaaatatatgtctatctatttgaaaacccttaagttgttaagggtaactttacataaaagtgtgaacaagctggcacaaattgtttaatgtttacagcaaaagataaccttcatggcgcaataaccactcttttcgctgaactccgcctgcatatccggtcatggtgccgtttcggccaataacccgatggcaaggtacgacgatgctgatgggattcgatccgtttgccgcaccaacggcacgcgccgcgccaggacggcccaattgctcagccagttggccgtaatgcattacctgcccgcaggggatagtgcgtagtgttttccagacttcgcgctgaaatggcgtcccccccgtagcagtgggaagcgtatcaataatgctaagattaccggcaaaatattcacgaagcttgtcgcttaaaccgcctggattggtggcagaaatgcgctcatagccttctttgcgataatggatgtccagcagctgcaccatgcgttcgctgtactcttcccattcaaccgcccgcaggcgaaattgctcatcgcaaatcacccacagtggacccagtggcgtggcaattttttcttcaagtaatctcagcatccgttctctcttaagacaaacgtgggtaaatacccggacctatcggcagaccgacaagataccacgccagcaacatcagcagccataccaccaaaaagataagtggatagggcaagactaacgaatagtaagtacccagtttcgcgtctggtttgtagcgttgcaggaatccaagaaacagtggaacaaaaggagataccggcgctaaaggcaatacggatgagtcggcaatacgaaagaggatttgcgcaaatgccgggtgaaagccaagtagcataaacattggtacgaaaatgggggcgagaatcgaccagattgcggaaccgctggcaataaacatgcataagaaagaggaaagcaacgccagaccgacaaacgccgggatgccgctaagccctgaactttccagtatatcggtcagccccacggcgatgaatttccccatgttgctccagttaaacatggcgacaaattgggcgaggggaaaaaccatcacgataaatcccgccatctctttcatcggttcaatcattaaatgcggtaaatccgcctgacgtcgaattgtgcgggtagcgatgccataagccagcgagacaacaaagaaaaaaagaatgatcagtggcacgatacctttaataaagggtgatggcatcacggtgtgattaatcggatcgcgcaatatcccgttttgcgggatcaccatcagcgcaatcgcagcaataaaaagtagcgatacgacacctgctatgcgtaaaccaaaacgctgactttcggtcaatgtctgcagtttctcatcgctgtttccctgccattgacctaaccgtggctcgatgattttgtcggttatcaggccgccaacaatcgtcagtacgactacggagctggccataaaataccagttatcaattacactgacgtgcatttgcggattgaacgcagctgccgcttccgtgctgatccccgacagcaacacgtcggttgtgacaatcagtaaattagccgtaaagccgcaacctacgcctgcaatggcagccagtaaacctgcaactggatgcctgcccaccgccagaaaaatcagcgcacccatcggtggcatgatcactaacgccgcatcggaagaaatgtggctgaaaaaagcaataaacagcaccatataactggcgtagcgggcattaacatgcgatgccattttaaccattagtgctggcagtaagccgacgcgctccgccagaccggcacctaaaaccagcgccaggatcgcaccaagtggagcaaaaccgctaaagtttttaataacattgggtaaaaaccagtgtaatccttccacactgagcaggtttttcaccacgaccggcgtaccatcggtcgggtttttcgcactgacgccaaaggccgacaaaattgccgtcgtcaccatgagtacgataatcaaatagataaagagcagaaaaggatggggaaccttgttaccaattctttcgacccagccatagagcttcccggattgggaggacgacggtatggatgacatactcatgggcattcctcggttgttgtgtttgcgttgttgttgttattttaaaggtgacggtgtcacgtttttcgggatagggcagtgatacggttgcgtgtccgttacttgctgatgctcttgttggcattcttgcaatagccctgaatcaaggaagagattgactgtggttgctgccatagttttcgccgccagcagcattcctttatgagcaatagatgttcgcccctggctaaccagttgccacgtatgtagcggtgtaccgacggcaaaacaggggctgaaacactgggcaacaggcagtttccaactgacgtcgccgacatcagtcgatgccgcaagcacgttatcggtggcggcatatggagcgacttcattcgccagtaccgtttcacgatgacgtagtgcaaaaaccttgccgttttcgccaccggttgcggcgatattattcagactgttttgccgatcgttggaggtgagcgtagcctgaatttgtttcgcaaaagccagttcttcggagttccattccggggtaccaaaatgggatagggcctggtacatggcattttctaaggtgcgattcgggagataactggaacaggctttgtcgaagcggcattcaaccgtggtttcggtcatcaatgccgcaccttcggcgattttggcgacccgatcataaatatgctgcacgtcggtcatttcgggggcgcggataagataaagcacttctgcctgcgcctggaccacgttgggcgagatcccgccgctatttgtgatggcatagtgtacgcgcgctttttcaataatatgttcgttgaggaagttggtgccagtggtcatcaacgttacggcatcaagggcgctgcgtcccaaatgaggggaattcgcggcatgtgctgcgatccctttaaagcgccatgatgcctgaatgtttgccagcgtgcgggtattgaacataccggcaaaggcttccgggtgccaggtgagtgccgcatccacatcatcaaataccccctcgcgaaccatgaacgttttacccgagccgccttcttcgccaggacaaccataaaagcgcaccgtgccgccttgcccatattgttccagccatttcttgacggctattgcagcggcaaaggcggcggttcccagcaaattgtgtccgcaaccgtgaccattttcaccgggcgtcacggatgtaggttgcgcgcaacctgcttgctgacttaaacctgccagggcgtcatattctcccagcagggcgataaccggtttgccttgaccaaacgaagcaataaaggcatttgggatattgcctacgttgcgggtaacggtgaagcctgcagattccagcgccgaagccagatgctccgctgaccagaactcttcaaaacgtgtttctggatgatcccagatttgatcggcaatatcggtataacgttggcgatcggcttcaatcgcatcgtcgataaaacgatagatttcctgcatcagatacctcgcgtccagggaaaattgagcgcggtgcgcgccagcgtttcgacggcaatagcgagaacctgctcgtcaaaatcgaatttttcgttgtgatgacctgccgccagctgtgtgccaaacaccacgtaggaggcttgcccttgatgttgctgcacgcgggccatcattaatgtggcatcttcggaacccgcaggcgcttcaacacgttcaatggcctgattgacccccgcgacctgagccgcctgactttgcaaccatgcgacccattgcggcgaaggagaactggcggtagctgcacccatcagacgagtttcaacgccgacaccatacatggttgctgcgccctgaatcgcttgttgtgcacggtcaaaaacatattgattaatgacgtcgctggccccgcgtgtttccactttcagcaacgccgaggcaggaacaacgttacgaccgcttcctgcctgcataacgcccacgtttactctggaagctccttcgctgtgcggggcgattgcatgcagtgcaagagtggcttgtgctgccgccaacaaggcattgtgaccgtcttctggttttgcgcctgcgtgagcggcggtaccggtgaagtgcgcgtcaaatttggtggttgccataaaattatcactgccgcacaccacggtgcccgcaggtacgccagtgccaatgtgcacggcagtaaaataatcaacatcatctacgacacctgcatcgaccatcgcccgcgcgccacgcgtaccttcctctgcaggctgaaaaatcagtttgatgacgccatgtagtccggactcgaactgtttaagggtatgcgccagcccaagcccaatggcggtatgtccatcatgaccacaggcatgcatcattccggcgttacatgacgcaaaaccgtcgcggtaggggcgatggctgacatcctgctcttcactgagatccagcgcgtccatatcgacacggaaagccatcaccggaccggggcgaccggtatccagggtggcgacgataccagtgaaaccaccttcaaaagccgcaatccattgtgctagcgcaccctgttgacgagcgcgctcgaattcgcgttgtagagtgaattcatcaggtaatcccatccggctactttcattaactacttcgcgacccagcgccagtgaatagccgagctggtgcaattcttccgcaacaagggtggcagtgcggaattccacccagccagactctgcatagtgatgaaaatcacgtcgccagtgcgataattttggggcaagcgaattaacaaattgattcaaagactccataacctttcccgtcatcagtaaaaagtgtgacccggttcacgtagcgatagtttttacttatcactaactgatttttcacagttttaaccgttcataaattaccctgacacaatcatctgcattaaagtagatgccagtttctttggtctgataaataacggttatcggtggcgtcatggcttttcaggtaaaaattcatcaaattcgggcttttgttgaagtggctcgtcagggcagcattcgcggagcgagccgaatgttgaatatgtcgcaaccggcactgagtaaatctattcaggagctagaagaagggttagcggcgcaactcttttttcgccgtagtaaaggcgtgacgttaactgatgccggtgaaagtttttatcagcacgccagtctaattcttgaagagctgcgcgcagcccaagaggatattcgccaacgacaagggcaactggcagggcagattaatatcggcatgggggccagtatttcccgcagtctgatgccagctgtcatatctcgttttcatcagcagcatccgcaggtaaaagtacgcattatggaagggcaactggtgtcgatgattaatgaattgcgtcagggagaattggatttcaccatcaatacctattatcagggaccgtacgaccacgaatttacttttgagaaattactggaaaagcaattcgcgatcttttgccgcccgggacaccccgccattggtgcccgttcgatcaaacagttactggattacagctggacaatgccgacgccacacggcagctactacaaacagttgagtgaattgcttgacgatcaggcgcaaacgccacaggtcggtgtagtctgcgagacgttctcagcctgtatcagtctggtggcaaaaagcgattttctcagcaaactgcctgaagaaatgggctgcgatcccttgcacggacaggggctggtgatgttgccggttagcgaaattttaccgaaagcggcctattatttgattcagcggcgtgatagtcgccagacaccactgaccgcgtcattaatcacgcaattccggcgagaatgcggctatctgcaaagttaaaactgcataaaaaaatagagtctgtcgacatccgccagactctacagtacacacagcagtgcatccgcgtcttaaatccggcattgtctcctctgcgccggtgactgtgttataacggttttaacctttagttgccaattttcttcagtgacagatttcacgaaaatataagttacattattaatatcgtgaatgaataatcatgcataagtattttgcttaaaatatcggcaatatttggaacttattactggaaatttgggtaatacgttgttggaccgacccggtctggttatcatatcgcgctcttaattgcgggaggatgtaacatgaaccttgacgacaaatcgctgtttcttgacgccatggaagatgtccagccgctgaaacgtgctaccgatgtccactggcatccaacgcgtaaccaacgtgcgccgcagcgtatcgacacgctgcagcttgataatttcctcaccaccggatttctcgacatcatcccactaagtcagccgctggagtttcggcgggaagggttgcaacatggggtgctggataagctgcgcagtggtaaatatccgcaacaggcgagcctgaatcttttgcgccagccggtggaagagtgccgcaaaatggtgttcagttttattcaacaagccctggcggatggtttgcgtaacgtgctgattattcatggtaaagggcgggatgataaatcgcatgccaatattgtccgcagctatgtggcgcgctggctgaccgaatttgatgatgttcaggcatattgcaccgcgctaccgcatcatggcggcagcggggcgtgttacgtcgcactacgtaaaacggcgcaggcgaagcaagaaaactgggagcgccacgctaagcgcagtcgttgatctcgagacgcatccgcggcttatgccgccagcacgcggttgcgtccatcatttttcgcccgatacaaagcatcatcaacgcgtttaaacagttcatcgatgctttcatttccttcgtgatgcgccacaccaatgctgacggtaaagcgtggtaagcccgaaatactcacttttgccacgcttacgcggatagtttcagccagcgaaagcgcggtatccagtggggttcttggtagcaataagacaaactcttcgcctccccaacgaaacaccaaatcgcctttgcgagcgcaactttcgagggtgcgggcgagggcgcataacacctcatcacctttagaatgcccatagagatcgttaatgtgtttaaaacgatcggtgtcgatgagcaacaagctgtaatcctgagcgatggcgagatgctgcatttggcctggttccgtaatgtgataaaactgtcgccgattcagtaatccggtcatcgcgtcatggtgagcagcatgttccagctgctcctccagccgtttttgctcagtaatatcatgcacaatacataacatgagcttgtcgccataaatttcaatcggtccggcataggtctgcacatgacgagtcgaaccatccgccagtttatgaacaaaattcaaaggtttatgaccaccgggtaaatgcgagatttcatgcatgataggcatgacgcgacgcccgagcatatttatttcccaggtatgtttctggcacatcgtttcatggttataaccatagaaattgagcgcggcgaggttagcatcgacgatttgtccatctcgtgacgggtcaatcaacaacattggtgcagagttagtcagaaaaaagcgcgcataaaaaccttgttttttgcgctgataatttgccgagcgactggcttttaaacccagcgttgccggcgcttcgataccttcgaaaataatcaccggttctgtttctgtcagctttcgcaaaacaagccgacagctcaatgctgtttcctcttctttacgctgaacagtgaggatttcgataatatcgtgttggttttgcagatcggagaggtatttcggcagttctttttgtgaggagacggaatagggtccggttcgtagctgactaaacgtgaggtcttgcatcaacagtttcgccgcgctattggcataaattaactgttcctcaaagggcgaaacgatccagacaggactggtgagtaagtccagggtattgaagttgtgcgtaatcattgagatcccgttatttttatcaatttttgttgctatccgatcgcaaaaaagccacgtcatatgatcagataattctgataatgatagacgctatttaacacttcacacggtttgtatacggaaaagcattttgctttttgtattcaatttagacagaattttattaatcatttcagggtaatggggtgatgagatgttgcgtaacagggccagaaggctagactacaaaataatgcgttgatgatggaggcactgtggaagcgattaagggatcggacgttaatgtcccggatgcagtatttgcctggatgctggatggtagaggcggcgttaaaccgctggaaaatacagatgtgattgatgaagcgcatccctgttggctccaccttaattatgtacaccatgatagcgcccaatggctggcgacaacaccgctgcttcccaataacgtacgtgatgcgctggcgggcgagagcacgcgtccccgagtcagccgtctcggtgaaggcacgctgattacattgcgctgtataaacggcagcaccgatgaacgccccgatcaactggtcgccatgcgtgtatatatggacgggcggttaattgtttcgacccgacaacgcaaagtgctggcgctggacgatgtggtgagcgatctggaagagggcacgggtccgaccgattgcgggggatggctggtggatgtgtgcgatgcgttgaccgatcattccagtgaatttatcgagcagctgcacgataaaattatcgaccttgaagataatctccttgatcagcaaattccaccgcgtggattcctggctctgctgcgcaaacaattaattgtgatgcgtcgctatatggcaccgcaacgtgatgtttatgctcgtcttgccagtgaacgtttgccgtggatgagcgatgaccaacgccgtcggatgcaggatattgccgatcgccttgggcgcggccttgacgaaatcgacgcctgtatagcacggactggcgtgatggcggatgaaatcgctcaggtgatgcaggaaaatttagctcgtcgtacctatacaatgtcgttgatggcaatggtctttttacccagtacctttctgaccgggttatttggcgtcaaccttggtgggatccctggcggcgggtggcaattcggattttcaattttttgtattctgttagttgttcttattggtggtgttgctttatggttgcatcgtagtaaatggttgtaacaaaagcaatttttccggctgtctgtatacaaaaacgccgcaaagtttgagcgaagtcaataaactctctacccattcagggcaatatctctcttgcaggtgaatgcaacgtcaagcgatgggcgttgcgctccatattgtcttacttccttttttgaattactgcatagcacaattgattcgtacgacgccgactttgatgagtcggcttttttttgcctgttatttatcagcgtctaccctttaagagtccacccaatgaccagagggaaatatgacgacacttatttatttgcaaattcctgtccctgaaccgattcctggcgatcctgttccagtgcccgatccgatccctcgcccgcaacccatgcctgacccaccacccgatgaagaaccgattaaattgtcgcatcgtgagcgtagatctgcgaggatacgcgcctgctaactttgcgtcgatgaccacgagaatagattgtgaccgctttttctaccctgaatgttttgcctcccgcccaactcacgaaccttaatgagttgggttatttaaccatgacgccggtgcaggccgccgcgcttccggcgatccttgccggaaaagatgttcgcgtgcaggcgaaaaccggcagcggcaaaacggcggcttttggcctcggcttgttacagcaaattgatgcgtcgctatttcaaacccaggctttagtgctgtgtcctacgcgtgaactggcggatcaggtggcaggtgaattgcgtcggctggcgcgttttctgccaaataccaaaattttgacgttgtgcggtggtcaaccgttcggtatgcagcgtgattcgttgcaacatgcgccgcatattatcgtggcaacgccggggcgtttgctggatcacctgcaaaaaggcacggtatcactggatgcgttgaatacgctggtgatggatgaggccgaccgcatgctggatatgggatttagcgatgccattgatgatgtcatccgttttgcgcctgcatctcgacagacgcttctgttttcggcaacctggccggaagccatcgctgcaatcagcggacgagtgcaacgcgatcctttggcgattgaaattgactcaacagatgctttgccacccattgaacaacaattttatgagacatccagcaaaggcaaaattcctctgttgcaacggttattaagcttgcatcagccatcctcttgcgtggtgttttgcaataccaaaaaagattgccaggctgtctgcgacgcgctgaatgaagtagggcaaagtgcattgtcattacacggcgatttggagcaacgcgatcgcgatcagaccctggtacgttttgctaacggtagcgcccgtgtactggtcgcgactgatgttgctgcgcgtggtctggatattaaatcgcttgagctggtggtgaactttgagctggcgtgggaccctgaagttcatgtacatcgcatcggtcgtacagctcgtgcaggaaatagcggtctggcgatcagtttctgtgctccggaagaagcacagcgggccaatatcatttctgacatgttgcagataaaacttaactggcaaacgccgccagctaatagttccattgcgacgctggaagcagaaatggcaacgttgtgtatcgatggcgggaaaaaagccaaaatgcgcccgggtgatgtattaggtgcactgacaggagatatcgggcttgatggcgcagatattggcaaaatcgccgtgcatccggcgcatgtctatgtcgcggtccgtcaggctgttgctcataaagcatggaaacagttacagggcgggaagattaaaggaaaaacgtgccgggtgcggttattaaaataatgaaatgttgaattgccgggtgcaagagtaaacatcttattcgggattgccggatgcgacgctggccgcgtcttatccggcctccataagagtagcccgatacgcttgcgcatcgggcgctatcctggttatttcacttcaaccacattcagccgtaactcatccaactgattttcatcttcttctggctgccagcacgccggttgtagtgggatctcttcgcgatcaaacgccagatcacccccgttaaccacttcagaaccgtgggtgatgcctttgaaatcgaacaggttggtatcgcacagatgcgacggcaccacattctgcatcgcgctgaacatcgtctcgatacgccctggataacgtttatcccagtcacgcaacatgtcagcaatcacctgacgttgcaggttaggctgtgaaccgcacaggttgcacggaataatcgggaacgcttttgcatcggcaaatcgctgaatatctttctcgcggcagtaggccagcggacgaataacgatatgtttgccatcatcgctcatcagtttcggaggcatacctttcatcttaccgccgtagaacatatttaagaacaacgtttgcaggatatcgtcacgatggtgacccaacgcgatcttcgtcgcccccagttccgttgcggtacgataaaggataccgcgacgaaggcgagaacacagtgagcaagtggttttgccctctggaatcttctctttcacgataccgtaagtattctcttcaacaatcttgtactcaacgcccagcttttcaagatactcgggcagaacgtgttccgggaagcccggttgcttttgatcgaggttaacagccaccagcgaaaaattgattggcgcgctttgctgcaaattgcgcagaatctccagcatggtatagctgtctttacccccggagaggcaaaccatgatgcgatcgccttcttcaatcatattgaagtcagcaatggcttcgcccacgttacgacgcagacgtttttgtaatttgttcaggttgtattgttctttctttgtaatttgttgattttcttgcattatttcagttctctggtactaaatggggcaaattgggggcaaactttgcaactacgataaccgcgcattcaacatggctatctgttcgtcgttcatgtcatcaatccacataccgtaaatttcatacaccatctgcgcagtttcatgccccatttggctggctataaatgccgggttcgctcctgccgtcaacagccagcaggcaaaagtatgccgcgtatggtacggattacggcggcgaataccagcacgttttactgctgcattccaccttgcccccaaactgcttaccgagtaataaggtttttgttttccgttacacaccctgggcatgaaaacaaaatgcagtttttgcttttcggttctgccgtactcccgatgataaaaggtgatttcgcttttgcgatgatgcccggtcagtttgtattgctccttcagtgcttcaagagcaggctgcagtagtgttactgttcggatcccggcatttgtttttgggggaccgaacatatcaagtatcgtcaggtttcttctgacattcactattcccttttcgagatccacatcctcccacgccagagctgccagttccccgtgacgaagtcctgagtaaacggcaaatttccacaagttctggctctgtcctttttcactttccattaatgcattgaattctgttttagataacggatcaggctttattctgtttcgctgtaatttttttactccttcaaatggtttggttgatataaatcccgactgatacgcaaaacgcaacagcgaacagagcagggcgatatagttatcaactgtgcgcacggttcttccttttttgttggatcttggattatccaggtaaagcgtttctccatgcagcagttcattccggtagtttaagatatcgctataacgaatatgtgatatcggggtactttcacaaattattattctgagtgtttttaattgtgatttcgttttcttcattgtgtttgttgttaactctgtctctttaatttttgtccagatatcacaaagctctccgaacgtttttatgactctcgttgtcaccatttttgccccagtgctggactggggaaaacgtcttaaatactcaaattcaccggagtttatttcatgaactatcagcgctcttaaatttccggcctttttaatattactgtttgtaatctcccagccttttaatgtttcccgacatcgttttcctcgaaacatgaaccagatgcgaatgtatctacctctaatctcgacacctgttggtaatttagacatatcatgagtctttgataaactgatttatctttggatagttgtaccagataatccctcgtttgctgtctggcttacctaaaggagatactcgtttgaagtggaagccctccacccaacagttctggcggtatgcttcaatttgtctggcccccagaccagtgcgaagcatcaggccgtattcaaccatccactcttcattaaagattacttgtgccatcgcatcacctctggcaggcgccaatgttagactgaaattgacgcccgatgttgattattaataatcagctatgaagttttaatttgaatacaatgcaattctcgaggactgaagtttctcgcaattaaaatttatcagttttactttctgctctctggaaacgcctgcttcttttttacctgagagcattttttcgcattctgatttcgttagtttagattttgaatatcttgtccagttagtaggagtgccaccttccttttcaatagtggcggtaattttatacatgaacacctccattattatttccagtggttcgtttattccatctttcgagtgcttctttttcacttccaccataaccggttcgggattcgcatccgttacacttcgctcggtaatatcctgaaatggctttcaccgttactgatggacaaccacaaaatggacatggtttaacattgtcatatctcataatttttctcataaaaaatatttcaagttggcggtgcattacaccgccaggctgaattattcctctgaattatcgattacactgtattccccggttaatacagaggaatctgcaggatcgattgtcagtggttccttttcatccattgatactgcacgctggatctcaattgatacgggcaaatatttgaacaggcgacgaatagccgttttctttgccatttcttcccagtgagttacccacggcccgttattaccagctttactcaggctgcgcaccagctcaatctgtttgcgcgtcataacttcaaactgagtacctccgtctttcagtcttgcgacagcatagacgtgggtaaccggggcatcttcgttttctcccgggcggtgtattaacttttcatcaaggccaaattcgaagctaaactcgtcaccttcacggacaacacgggctgacaggctggcgatttgaccagaacggcgagccagatcaatcatgccgcgatagccaatgattagctgaacgttctttttaccgctcttttcgtttttattaccaaaaggcagtaaatatgcatgaccgagggcgctacctggctcaagtccgagctgtgaacactgtacgatcgcactgacaaaactcatagtgtcacagtttcctaacgccggaactttacgaatttctgtggtggcgatacggatcatacgttcagccgtcatatggcgtggaagagctgctgccagttgctctttcattgatggctggttaataaaactaatcacgtcgctatttttaactgctgctggtgcacggtttccctgagttttttgcagatcggcttttgcgattggtggttgcttagtcatttgcatattccttagcccagcggggcagtgataatgtcttaatagctggccattcatcggtattcaggcagtcagacagggttcgcagattgcggtgatattcctgttgacctgccagttttgcttcttcgcccatcatgaaaatttcaaccggataacgtccgcattcaatagttgtgctggcaaccagaaaaacgaaagttggctgcactccaaactgtgcttcataaccgtcactgtagaatgcatcctgaacgtgatagcggtagtcgtaataagcggttttgaatcgttgaatatccgccgtagttttcacgtccatgatccagtgaaattcagggataattttgtccggacggcaccgacacaaaattcctgtttcaggatcttcccagtaaattgatgattcagcgtgtccggcgctttcaacaagccattgccccagcggcaaagccataacgctttgatacatgagttcaattttccggccttcttccgcagtgataaccgtttttcctgtgcttgcgcattccatcagaaacgctttctcttcttcttttccggcgtttgtacggcggttaaattcaggtgctacgataaagcggttactgaattcttccggttcaagtacccggcagtggaaagcagttcctaaatcgagcgtttttgtctttgtggtgtccacgggggcatttttacgccacaaatatagtgccggagtatcagcaatgtcatcgagctgagacttactgataccgggacccgcgtggtaattctcattcgaaattccgtaataaatacctggctctatgtcttctacgattacgggatctgcgacttcgccagtttcatcactgcaatcgcgatgcggatcgctgccagcattctcattgtgcggatgttcagcgccttccatttcctccggatcattttccttagcttcaacctgactctcttcatcgaatgtttcctggtatgttgcgtcgcccatcaccgcaccacagtcagggcagttatccccgccagtctggccgcaggcattgcaggctatttccggttcctgttgcactactggctcaggttgattcatatctgggctggttttttccgtttctggctggttctggtacacacaatcgcgagtctggatcccctttacccatttcggatcgttcgggtcgctaattccgtcaacaaattcaccacgtgatgcagcaagcaatttatcgtcatcgacaggattttttgatggaatgtttttccgggcttcatggagttctgcccgcagttcctgatatttcgcatcaacagaatttacctgtgactgagcatccagcggctgcgtgtcctgatgatgttcagttgcgtccggttccattgtttcagcctctccctgttcaactgccgttgttccagatggttgcggtttttcttcatcatcctgttttccttcttctgttactcgctgcggcatcggggcagaggagcgaccgcaggcaatatccacgatttccggatcagggttggcatgatcggtttcagtcagtactttgttcagatattcagtgacgtgcgcggggatgacctcgatcccaattggtgcttcttttacggacgcaaccacgatggcgcgggaataatccagcccgccaggcatggtgatgaatttgtcgcggaaaacagaaaagggcggtttattttcagcgataatttcctcaatgcgtttagcgtgtgccggatgaaggttatagatgtccagatccattgaacgggccagtacgccagtggctacgtcgcgcgccagtgacgtcagatcgtgtacgaaaccttcgccgcgatcggtgaggtttccgccgccagcattagcaccggaagccgtgcgagtgatgtgtgaaacacgattacccttcatccactcttttgtcagcagtcctcgatcggtgtagtcagcgttcaggtatgcttcgaaaaaagcagttatcagtcccaggtttgaattaccaggattagggaaaactttgtcagtgtcacgaaccagtttgtggagttcgcgaatttccagcgggtcgagcaggctggttttgtgggaaacagccagggcagtaacagccggtagttcttcagcccgagcaatgtgtaatgcctggagtccgtcgcgtgaaacgtgcgttaccggtttttcgctgccgtgttgagcaagccaacgaatgggcagttcctggccagaaattgggagtagcatattctcctcaatctcagtcatgtcttcgccgttgacgttggtattgccttgatagtgagcgttgtctggtgctgctcccggttttagttcccatgtcatggagtctttgctgagttgatagcgttcactccaggtaaaatcgatctcaccttcagcgggcaggtcattaacgacaggaaaattcgtggcaacagctttaaaatagctgctcagttttttacctgacttaacgatcaggtagtccagagtggcacaggtcgattcaaaatcgttgcttgcccacaggacgacgtcaggttcaccggatgattttttcgctttccgtaacaggaagagtggttttgtgctcattgttttttaacctcaactcagattaaaattcgttttgttcagtgaatgatcttgccggatacacactgttcatagcctgcgccatacgcaggctatttctttcagatttcaccttttaatttcattgcaattagagttgccagaaattcggcttttttttctgcgggcagattctttccgatatgcaccaggcacatttttttgacaccttcatcaagtgtttttacgttgcctgatggaccatcgatatcaaccacagtgaatggggtttctttattttctgttttaattacgtagccaatgcgctttccttccagattcacctcgtgaacaatgtcatcggtagttacaacagtggcttcataattggtaatcatgtttttctccttaattaaggttgagcgaatacctgccatttctggcataaattcagtttcgaatagtcaattaattaaagttcatgtgccatctggtctttttcggcacaagcttcactgcaatattttctcggttcgtcttttgataaaatcccgtgcatgaagtgaagcattctttcaatagctttgctttcttcaacgtcttttttgcaaaggtggtaagcacattttattttcttagtcatcaccatgactccgcctttacaggtaaaccatcacgaccgaggaagactttaatcatgcggtcagtaatgaatgtttttgtggtcaggttacgaatatatagttttcgctttttaatattgtttgccgaggcaatatatgtccggccttcatgaagaacataatcgccaggagtcacacactgacgtggtatttcatcagttccgaagtgatgtgcaatcataattatctccatttttacaaatgaactttgttgatgcggtgtctggtgcctccaggtgactgcaaccagttaacaattacagtcggctttcccacccaaaccaataaggactaacatgacttttaactgtgccacgtgcgcttagccgcattcaccgcatcacaaaattcactttaaaaagggcggacatcagccgaacttcaagaaaaaaactgatgccgccaggactacacacagcaatgtcgttatttacaaccggaggcgcactcccaccatttaaatttaacagacaagaccgactctttatggatatcggaaatgcgccttcgtgttgtgcccggttttatttcaccacctccgggcttcggtggtctcggctatacccctacagcgagagcttgtgttaacatttcaatacccttacagttgagagttattgatatgttggatgtatttactccattgttgaaactttttgctaacgagccactcgaaagacttatgtatacgattatcatttttggtctcactctctggctgataccgaaagagtttactgtcgcattcaatgcttatactgaaataccttggctctttcagattatcgtttttgccttttctttcgtggtcgccatttccttctcaagattgcgagcacatattcaaaagcattattcattactaccagagcaacgagtattgcttcgtttatctgagaaagaaatcgctgtatttaaagatttccttaaaacaggaaatcttattatcacttctccttgccgtaacccggttatgaaaaaattagaacggaagggcatcattcaacatcagagtgatagcgcaaactgttcttattatctcgtcaccgaaaaatactcccattttatgaagttattctggaacagcaggagtagacgttttaatcgttagcttactgtgtgcttctccaaccatcggcgcgcaccagtttcggttttaaatgttttgcttttggtatacgtcatggcagtgaacgttccatcctggttggggaacacgccgcacaccagggattcgttgttgccgaggtcgattttttgcattttgcgaatctcacatcttgttgctacgtatagcgacttctgcctgccagagatcccagtcgttgctgcgtaaagcctgcacagcctggttgtaagtgataccgcaacaatccatcaaatactgaactacttcgtaatgcaccatcttatctctccccttaacgccgggtggcggaactaactgctgcactgcaaaatttgaatcccgccgtcatgttcatacgcctcgggctggctacttaaccccttaccactgcctggtaactcgaagtattgcccggcgttctgtggggcggggtgggtggtatgctggaactataggtaatgcctaattgattgtcaataggctatgcctaatgttttgagcgtaacctaataggtgatggcgacagcagaaagtgatgggggggttaaataacggaatccaggagttttccgtcagaccatataagtttaagttccagtttttgtgatgttctggcttttccgttcagattcaagagctttcagatacttacccactttcatttccatcgctgctatgtaggcgcgaacatcgtggtcaacccaatctggttctgtagcatttccagataacaggaaagctacaatcgctcttatttcatcagaggctgcttgataaaggttgtttatatctaaaagttcactttttgtatctgaattggtgggggttggtatggggtattcgttaagcccccaatgctctggaccaacaacatcagaaaagaaacgccataattctggaagtttatctttacttatagagcctttcttaatccagtcataaattgatggtggttggactttaaagtggcgtgcgacctccgcctttgatttgacggatcccgatgcgatttttttgttaatggcctgctctatcgctcggcctaagtctttaccactaagcattgcttaatattctcctatgcgcattacattaggcaatccctacccttactgcattaggcacagcctattgacaattgcgttaggcgtcgcctaatatttctgtgtgtttttggagttcattcgatgaaaaaagagaactattcattcaagcaagcttgtgctgttgtcggtgggcaatcagcaatggctaggcttttaggtgtatcacctccaagcgtaaatcaatggatcaaaggggtacgtcaattgcctgccgagagatgtccagcaattgaacgtgcaacaagaggtgaggttctgtgcgaagaacttcgtcctgatattgactggtcatatttacgacgttcggcatgttgttcgcagaatatgtcagtgaagcaactaaatgacagtaacaaatcctcatttgatcatacctgaaacatcaagaggcaaatgattcatgaaaatcaagcatgagcacatcgaatcagtgttgtttgccctagcagccgaaaaagggcaggcatgggtagccaatgcaattactgaagaatatctgcgccaggggggcggcgaattgcccctggttccaggcaaggactggaacaatcagcagaatatctatcaccgttggttgaaaggtgaaacgaaaacgcaaagagaaaaaattcagaagctgatcccagcaattctggcaatccttccgcgcgagctgcgtcaccgactctgcatcttcgataccctggaacgccgtgcattactggcggcgcaggaagcgttaagtacggcaattgatgcgcatgatgatgcagtccaagccgtttaccggaaagcgcatttcagcggcggcggttcttccgacgattctgtcattgttcattaagcaaaagtttccatgctgtttgtgcttattctaagccaccgggcagcatcatacggggcaattatggccgcattaccatacatgcaactgtacatagctgattacctggctgacaccatgcatttgtcagcagaggagcatggtgcgtatttgttgctgatgttcaattactggcaaacaggaaagccaatacctaaaaacaggctggcaaaaattgcccgtctgactaacgagcgatgggctgatgttgaaccatccttgcaggagtttttttgcgataacggcgaggaatgggtgcatcttcggattgaggaagatctggcatcagtcagggaaaaattaaccaaaaaatcagccgcaggaaaagcatctgttcaggccagaagaagcagaaaggaagcagatgttcaaacaaaacaagagagaaatttaacaggtgttcaaacagatgttgaagtggtgtttgaacatgatgtcaacacaaaggcaactaataaagatacagataaagatctaaaaacagatccccccctaaatcccccccgggggaatcgaggtgtcaaaaagtttgaccctctggatattactttgccgaactggatttctgtctcgctttggcgtgagtgggttgaatttcgccaggcattgcgaaaaccgattcgaacggagcagggcgctaacggggcgatacgggagctggaaaaattccgccagcagggtttttcacctgagcaggtgattcgacacagcatcgccaatgaataccagggcttgttcgcgccgaaaggtgttcgacctgagacgttactccgacaggttaacaccgtctcgttaccggatagtgcgatcccgccaggcttcagggggtaactgaccatgaaaaatattgcgacaggcgatgttcttgaacgtatccgcagactggccccgtcacatgtaaccgcgccattcaagacggtagcggagtggcgcgagtggcaactttccgaaggccagaaacgttgtgaggagatcaaccgtcagaatcgtcagttgcgggtggaaaaaattctgaatcgctctggcatccagccattgcaccgcaaatgctcgttttcgaattaccaggtgcagaacgaagggcagcgatacgcgttgagtcaggcgaaatccatcgctgatgaactgatgaccgggtgtacaaattttgcgttcagcggaaaacctggtaccgggaagaaccacttagcggcagctatcgggaatcgcctgctgaaagacggtcagacagtgattgtggttaccgtggctgatgttatgagtgccctgcacgccagctatgacgatgggcagtcaggcgaaaaatttttgcgggaactgtgcgaagtggatctgctggttcttgatgaaattggcattcagcgcgagacgaaaaacgagcaggtggtactgcaccagattgttgatcgccggacagcgtcgatgcgcagcgtggggatgctgacaaacctgaactatgaggccatgaaaacattgctcggcgagcggattatggatcgcatgaccatgaacggcgggcgatgggtgaattttaactgggagagctggcgtccgaatgtcgtccagccaggaattgcgaagtaatttttaccgggagaaaaatttaatggagactgtttttgacgcactgaaagcaatgggaaaagccacatccatagaacttgctgcgcgacttgatatcagtcgtgaagaagtgctgaacgaactatgggaactgaaaaaggctggttttgttgataaaagcgcgtacacctggcgtgtggctgataacaatgttcagcaggaacagccagcgcaggcagaactgccggaagaaatcaccacagcaacagtagcgaaaatctcagagtgcgatttaaccgcgacgattgaacaacgaggaccacaaacggctgatgagctggctacattgtttggtaccacatcacgcaaagtggcttcaacgctggcaatggcaatcagcaaaggtcgtctgattcgcgtaaatcagggcggtaaatttcgttactgcataccgggcgataatttaccagcagagccgaaagcagcatcggtatctccgctctggttatctgcatcgtcgtctgcctgtcatggggtgttaatcattaccgtgataacgccatcgcctacaaagaacagcgcgacaaaaatgccagagaactgaagctggcgaacgcggcaattactgagatgcagatgcgtcagcgtgatgttgctgcgctcgatgcaaaatacacgaaggagttagctgatgcgaaagctgaaaatgatgctctgcgtgatgatgttgccgctggtcgtcgtcggttgcacatcaaagcagtctgtcagtcagtgcgtgaagccaccaccgcctccggcgtggataatgcagcctccccccgactggcagacaccgctgaacgggattatttcaccctccgggaacgactggtaatgatgcaggcccaacttgaaggtgctcagcaatacataaccgagcagtgtttaaagtaaaatcttaactacaatatgattcattttgatgattgtttcataaggaacagtgaagtaagatctaagaggagttaaattttatacagtataatcataatattgcagcaaggtggttataattgaaagaatatttagatatgaatacatctcatgtaagagttgttactcatatgtgtgggttcctggtttggctctatagtctttcaatgttgccaccaatggttgtagcattgttttataaagaaaaaagcctgtttgttttctttataactttcgttatatttttttgcattggtggcggagcgtggtatacaactaagaaatctggcattcaattacgtacccgtgatgggtttattataattgtaatgttttggattttgttttctgttattagtgcattccctttatggattgactcagaacttaatttaacgttcattgatgctctgtttgaaggggtttctggaataacaacaacaggagcaactgtaattgatgatgttagttcattacctcgggcatatttgtactatcggtcacagttaaattttataggtggtttaggagttattgttctggcggttgctgtattgccattattgggtattggtggtgcaaagctttatcagtcagaaatgccggggccatttaaggatgacaaactcactccccgcctggccgatacgtcacggacactgtggataacttattctttattaggtattgcttgtattgtctgttatagacttgcaggaatgcctttgtttgatgctatttgtcacgggatttccacagtttcgcttggtggtttctcaactcatagcgagagtatcggatattttaataactatttggttgagctggtggctggttctttttccctgctatcggctttcaacttcactctttggtatattgttattagcaggaaaacgataaaacctttaatcagagatattgaacttcgtttctttctgttaatagccttaggggtgatcattgttacctctttccaggtctggcatataggtatgtatgacttgcatggaagttttattcattcgttttttcttgccagctccatgctcactgataatggtttagctacgcaggattatgcaagttggcccacgcacacgatagtgtttttgctgttgtcaagtttctttgggggatgtataggttcaacttgtggtggaattaagtcacttcgatttcttatacttttcaaacaaagcaaacacgagataaatcagctttctcatcccagagcgttgttgagtgtaaatgtaggagggaagatagttacagatcgtgtaatgaggtctgtatggagtttcttttttctttatactctcttcacggtgttttttatactggtgttaaatggtatgggatatgattttcttacatcatttgcaacagtggctgcatgtattaataatatgggattaggttttggggctactgcatcgtcattcggagtgcttaatgacattgcaaaatgcttaatgtgcatagctatgattcttggtcgccttgaaatttatcctgttattatattgttttcaggttttttttggcgctcctaatatatggctgatttataattgtgagtttaatattatgttgactcactcattgatccaatacctaactttaccagcaacacctccgtccccagtagcactggctgctggggtgcgttttattcataaagcaaggctgtatgagcgagaaattaaagatagtctatcgcccattacaagaattgtcaccgtatgcgcacaacgccaggacgcacagtactgagcaggtggcacaactggtagaaagtattaagcaattcggctggactaatccggtgctgattgacgaaaagggcgaaattattgcgggtcacggtcgtgttatggcggctgaaatgctcaaaatggattctgttccggtcattgttctgtctggcctgacggatgagcagaagcagcgataacgatcagtatcgctcccgtaatgcattaatccgtcgccacattgagaaaatggatgccagtttgcacgtcggaacgaaggagtttgatatttcaaaggtttccgaggtggattctgttgatgatttactcattgataatgccgctcgttatctgctgaaagactggaaaggggttggtgaactggttaatggtgttgaggttgcactggaatatacggcagaacgagggatcgcgctgcttaagcagaatccagagttgtactggcagatccttgcagaagcagccagcatcgcccagggtaaagagcagcagaagcaggatacgataaaaaagccatagctgcccagcggtggttatcggagttcgggggagaaaggggggaaaaggcaagatggaagcgagaaaaactcaggttgccaccgataccggaaccagaaatagacccggtgcttaaggagttgttgtacgcctattcggtaatatcccgtgcccgacgttatgctggaatggctggggtgcctttgcctttatctctgacagagataaatgaatatttagccactcatccggtattgattgagcgcgatgaatttgaagcagtgatctttgcactggatgaccagtattttcaggagcagtgtgtgtagttgttaattacgtacactctgttacagagatgtgatggtgtctttaattaaatcgatgatgctcctggagaaaagcattgcgtggcctcgtaatcgctatatctactattatgtcgcctgaaacccacttcgcggtgggttttttgttgtcaggagttttaataaatggcagagcaaacctcgcgtctcgcaataattattgatagcactggagcgaaaaataatgctgacaatctgacctcctcattagtcaaaatgacgcaggctggggaaactgctgcaaatagcgcagggaaagtgactaaggcaacagaagatgagaagaacgcgctcgcaaaattaaaagcagctattgatccagttggtgccgcaattgatactgtcggtcgacgctattctgaattaaagaaatttttcgataaagggcttattgataaagaagaatatgaatttcttgtccgtaaacttaatgaaaccacagaggaattgagcggggttgcgcaagcgcagagagaagccgagaaggccggaaaacttgctgccgctcagcaggaagcgcaggctcaggcctttcaaagaatgctggacaagatcgaccctctggctgcggcgctaagaaatcttgaacaacagcatgatgaacttaatgctgcgtttgcatccgggaaaataaatggttctcagtttgagaattatagccgaaaaatacaggaaacacggcgagagcttaccggagaggctcaggcagagcgagaagcagcaaaagcgcatgatgaacaggttgttgctttgcaacgtctgattgctcaacttgatcctgtcggaactgcttttaatcgtctggtagaacaacagaaacagctcaatgaagcaaaagctaaggggatgctttctcctgaaatgtatgaggagctttctggaaaacttcgtgctatgcggagtgagcttgaggttactcaatcacaattaagcaaaaccggaatgtcggcaaaacaaacggcttttgctatgcgcatgttgcctgcacaaatgacggatattgttgttgggttgtccactggtcagtcgccatttatggtgttaatgcagcagggcggccattcagctatgcaggagacaagaatcgccagcttacccgttacagcgatacccgctggcatgaagattccgtgcgtaaccgctggttcagcgtgatggtggggccgtctgtgcgcgtgaatgaatggttcagcgcgtatgcgatggcgggtatggcttacagccgtgtgtcgactttctccggggattatctccgcgtaactgacaacaagggaaggtgcgaataagcaggtcatttcttcccaagctgactcgctgattaaaatttcgcggatctgggccgatttttttcccgcaaacacatcgaatcagcctatttaggctattttttccaccatttctggcgttatttccggtttttactgagatctctcccactgacgtatcatttggtccacccgaaacaggttggccagggtgaataacatcgccagttggttatcgtttttcagcagccccttgtatctggctttcacgaagccgaactgccgcttgatgatgcgaaacgggtgctccaccctggcacggatgctggctttcatgtattcgatgttgatggccgttttgttcttgcgcggattctgcttcaaggtttttaccttgccgggacgctcggcgatcagccagtccacatccacctcggccagctcctcgcgctgtggcgctccttggtagccggcatcggctgagacaaattgctcctctccatgaagcagattacccagctgattgaggtcatgctcgttggccgcggtggtgaccaggctgtgggtcaggccactcttggcatcgacaccaatgtgggccttcatgccaaagtgccactgattgcctttcttggtctgatgcatctccggatcgcgttgctgctctttgttcttggtagagctgggtgcctcaatgatggtggcatccaccaaagtgccttgggtcatcatgacgcctgcttcggccagccagcgattgatggtcttgaacaattgacgggccagttgatgctgctcgagcaggtggcggaaattcatgatggtggtgcgatccggcagggcgctatccagggataatcgggcaaacaggcgcatggaggcgatttcgtacagggcatcttccatggcaccgtcgctcaggttgtaccaatgctgcatgcagtgaatacgcagcatggtctccagcggatagggccgtcggccattgcccgccttgggataaaacggctcgatgacagcggtcatattctgccatggcagaatctgctccatgcgggagaggaaaatctcttttcgggtctgacggcgcttagtgctgaattcactatcggcgaaggtgagttgatggctcatgatgtccctctgggatgcgctccggatgaatatgatgatctcatatcaggaacttgttcgcaccttcccaaggggaaaacgcacgacgtgctgaccggaagtgatgacggtcgccacagcaacacgtctctggcgtggggagctggcgtgcagtttaacccgaccgaatccgtggccattgatattgcttatgaaggccccggcagtggcgactggcgcactgacggtttcatcgtgggtgtcggttataagttctgattagccaggtaacacagtgttatgacagcccgccggttcaggcgggcttttttgtggggtgaatatggcagtaaagatttcaggtgtactgaaagacggcacaggaaaaccggtacagaactgcacaatccagctgaaagcaaaacgtaacagcaccacggtggtggtgaacacgctggcctcagaaaatccggatgaagccgggcgttacagcatggacgttgagtacggtcagtacagcgttattctgttggtggaaggattcccgccgtcacatgccgggaccattaccgtgtatgaagattctcaacccggtacgctgaatgattttctcggtgccatgacggaggatgatgcccgtccggaggcactgcgccgttttgaactgatggtggaagaggtggcgcgtaacgcgtccgcggtggcacagaacacggcagccgcgaagaagtcagccagtgatgccagcacatcagcccgtgaggcggcaacccatgcggctgatgctgcggactcagcacgcgcagccagcacgtcagccggacaggccgcgtcgtcggctcagtcagcgtcttccagcgcaggaacggcatcaacaaaggccactgaagcatcaaaaagtgctgccgctgcagagtcctcaaaaagcgcggcggccaccagtgccggtgcggcgaaaacgtcagaaacgaatgcttcagcgtcactacaatcagcagccacatctgcatccaccgcgaccacgaaggcatcagaagctgcgacctcggcccgggatgcggcggcctcaaaagaagcggcaaaatcatcagaaacgaacgcatcatcaagcgccagtagtgcagcttcctcggcaacggcggcaggaaattccgcgaaggcggcaaaaacgtccgagacgaacgccaggtcttctgaaacggcagcgggacagagcgcctcggctgcggcaggctcaaaaacagcggctgcgtcgtctgccagtgcagcgtcaacaagtgccgggcaggcctcagccagtgccaccgccgccggaaaatcggcagaaagcgccgcatcgtctgcttcaacagccacaacgaaggctggcgaagccactgaacaggccagcgcagcagcgaggtctgcttccgcagcgaagacatccgaaacgaacgcgaaagcgtcggaaacaagcgcagaatcctcaaaaacggctgccgcatcgtcagccagttcggcggcgtcatcggcatcatcggcgtctgcttcaaaagatgaggcgaccagacaagcgtcagcagcgaagagcagcgccacgacggcatccacgaaggcgacagaggctgctggcagtgcgacggcggcagctcagagcaaaagtacggcggaatccgcggcaacgcgcgccgagacagcagctaaacgggcagaggatattgcatccgccgtggcgcttgaggatgcaagtacgacgaaaaaggggatagtacagctcagcagtgcgaccaacagtacgtctgaaacgctggcggcaacgccaaaggcagtaaaatcagcctatgacaatgcagagaaacgtctgcagaaagaccagaacggcgctgatatacccgataagggatgcttcctgaacaacattaacgcggtcagtaaaacagactttgctgataagcgtggtatgcgttatgtgcgggttaacgctcctgcaggtgcaacatctggaaaatattaccctgttgttgttatgcgttctgctggctcagtaagcgaactggcatcaagagtcattatcaccacggcaacgcgaaccgcaggcgatccgatgaataactgcgagtttaacggatttgttatgcctggtggctggactgacagggggcgttatgcttatggcatgttctggcaatatcaaaacaatgaacgagccattcactcaataatgatgagtaataagggcgatgatttgcgctctgtgttctatgttgatggcgctgctttccctgtttttgcgtttattgaagatggcctgtcaatatccgcacctggtgctgatctcgttgttaatgatacgacctataagtttggggcaacaaatccggcgactgaatgtatcgcggcggacgttatccttgattttaagagtgggcgtggtttttatgagtctcattcgttaatcgttaacgataacttgtcgtgcaaaaaactttttgccacagacgaaattgtagcgcgtggtggtaatcagattcgaatgataggtggggagtatggtgcattatggcgtaatgatggcgctaaaacttacctgctgcttaccaatcaaggtgatgtttatggtggctggaatacattaagaccgtttgctattgataacgcaaccggcgaactggttattggaaccaaactgtccgcaagtctgaacggtaatgcattaacagcaacaaagctgcaaacgccaagacgggtttctggtgttgagtttgatggttccaaagatattactttaaccgccgcgcatgtggctgcttttgccagaagggcaacggatacatatgccgatgcggatggtggcgttccatggaatgccgaatctggcgcttacaatgtcacccgctctggcgacagctatattctggttaacttctataccggagtcggaagttgccggaccctgcagatgaaggcgcattacagaaatggtggtctgttctaccgttcttcaagagacggttatggttttgaggaagactgggcagaagtttatacctcgaaaaatcttccaccagaaagctacccagtcggcgcaccaatcccgtggccatcagataccgttccgtctggttatgccctgatgcaggggcaggcttttgacaaatctgcttacccgaaacttgcagccgcttatccgtcaggcgtgatccctgatatgcgtggctggacgattaagggcaaacctgccagtggtcgggccgtattgtctcaggaacaggacggcattaaatcgcatacccacagcgccagcgcatccagtacagatttggggacgaaaaccacatcgtcgtttgattacggcactaaatccacgaataacaccggggcacatacacacagtgtgagcggctctacaaactcggctggagcacacacacactcactagccaacgtgaacacggctagtgctaactccggtgctggtagtgcatcaacaagattgtctgttgtgcataatcaaaactatgcaacatcatctgctggcgcacatacccactcactgtccggcactgctgcaagcgcaggtgcacacgcgcatactgtcggtattggtgctcatacgcactccgttgcgattggttcacatggacacaccatcaccgttaacgctgctggtaacgcggaaaacaccgtcaaaaacatcgcatttaactatattgtgaggcttgcataatggcattcagaatgagtgaacaaccacggaccataaaaatttataatctgctggccggaactaatgaatttattggtgaaggtgatgcatatattccgcctcatacaggtctgccagcaaacagtaccgatattgcaccgccagatattccggctggcttcgtggctgttttcaacagtgatgagtcatcgtggcatctcgttgaagatcatcggggtaaaacggtttatgacgtggcttccggcaacgcgttatttatttctgaactcggtccgttaccggaaaatgttacctggttatcgccggaaggggagtttcagaagtggaacggcacagcctgggtgaaggatacggaagcagaaaaactgttccggatccgggaggcggaagaaacaaaaaacaacctgatgcaggtagccagtgagcatattgcgccgcttcaggatgctgcagatctggaaattgcaacggaggaagaaatctcgttgctggaagcatggaaaaagtatcgggtattgctgaaccgtgttgatacgtcaactgcacaggatattgaatggccagcactgccgtagggtaaaacatataaattctataattagatgtatctttccatttacggcaaggaagggggcttggaagacgtaaagcatctcacaccgagattattttttatatgtcaggtgtctgaagttttgctttggctcttaaaatggtttgccgcgaggttttgaattcccgggcaatggcacttatacttacacctgacttaattcgttcgaataccacctgtttctgttcttcatttaacacaggaggtcgaccaaaacgtttccctgcgccgcgggctcttactatcccggaatgagtgcgttcaagtaaaaggtctcgttcaaattcagcgactgctgaaattacttgcatcatcatttttcctgttggactggtcaggtcaatgccacccaatgctaagcaatgcactctgatacctgtttcggtcagttgttccactgttttcctgatatccattgcattacaaccaaggcgatccagttttgtcacaatcaattgatcaccacatttcaggcgagcaagcaaccggttaaaaccaggacgctcactggttgctgctgagccgctaatgtgttcttcgattatttgctgaggtttgattttaaaacctgcactttcgatttcccggcgttgattttcggtggtctgatccagcgttgatatccgacagtaagcaaaaattcgagacatagtgagactctatacgaaattggtgttcatatcataatgcatctcagaaaataattatgattatttttgtgcatatttgtatgtacacgttcgaaaataaacgaatgcgtatgcaaccccgtaattttggtgagacccaaaatcgattttgtgaaaaatggctttaactcggtttgtttttcgagttccgggcggactcaaggaagaagaatagtgttgcgtgttattttaaccagatttcaagttgtttggtcgtggaaaagtggagcaaaatgttgttaaagtggaaaaatgataaaaaagtaagtttattatattacattttaccatttaaattttggttgtctttaagaactgatatcgctgtttgtaataattctttgttatccagccatgatgttttctttatgtttccttcaatgtaatcaagcaatgttctggtattgataggtcttccctgttttgctacttccactacagcatcccctaggataattcttacttcaggaagctgcgcagggaaccactttagggtgtcttttgatttcatgaagatattccttaaaatattattgattttcattgcgatattgtatgtctgattcaggatatgttgacttatacatcggttttgtctgggttattggatatgccaatccctaattttattagagcatgactaaaaatgctgaatatgataaggagcgaagtgattatcagtatgctgttcatatagcctcgaattagtaatgtgttatatatgatatagttgacaatttttatcctgggtgttcttaaagttcgtagataaacattgtcgtttcaggtatacaggaatgctaacaggtggcggcaaaaatcaggcggtttatggcgcaagctgaagtggcaactgcaaactatcttatgcagagactctacacggattgggtttaaaagtatacatagataacagtttttatctgaagaagaaaaatatcaaggtgatatagcctatatgcctttgatgcggaggaatgaatgtgatgggagtgatgtatctgaatagttgaaaaaccgcagtcacgtcgtatgcaagaacgtgctgcggttggtttgactttgattgagacgttttggaatttttttcggtggcaaaaatggggcaaaacgctgcaaaaggggcaaaaaaggggcaaaaaaagagtggattatcgtagcttattgttgtcgctgatgatatttaacacattgaaaaataagtaaaatacttatgagtcagagagttgtgatttttgcccttacttgttcaggttgtattgttctttcttactaatttcttgattttgcgacatttaaaagcgactcaattcgttatatggcatcagaagagtatgcgtcatgccggaacgcccagcataagaaatctgatataaaaaactgtggcgtgtatggtacggattagaggggaaaatgtcagcacatttgcgaaatgaatcaaaaagcccgcagcaatgtgcgggcgttagtgtcagcgcacaaccagcacggagcactctgcgtgacgcactacagctgcggcgttggaaccgagcagataagtggtgatatccggtcgatgggaagcaatgatgatcatatgagcggggatcttcttcgccaattccagaatgcggtctttgggcgagccttcctcaacatggacatgcactctgtcggttggcagtttaaattttttaatgatctcttccagttgcgatttggcttccgctttcaggtcatccattgccggtaattctgcggaatacgctaaacccagagaggcatagtagggcagtgaaggtattaccgtcaggaaatgaacctctgcatcatcaatctttgcctcttcctcaacgtggctaatcacgcgttgagttaattctgaatcggaaatatcgatagggacaagaatcgttctgttcataaaacctcctgttttagtatccgcataaagtgtaacgccagatgacactttttgtgtaatgacggagttcacatttttaatttagatcaaaggaggaagaataagcagaaaaagcccgccataacagcgggcaggaggatttagaactgataaaccagacctaaagcgacaatatcatcggtagagatgccattggcagcgtagaagctgtcatcttcatccaacaggttgattttatagtcaacgtaggtggacatgtttttattgaaatagtaagtcgcgccaatatcggcgtatttaaccagatctttatcatcaacacctgccgggttgtctgcaccacccgcagcgtgcaggtcacggcctttagacatcaggaaagagactgccggacgcagaccaaaatcaaactggtactgtgcagtgacttcaaaattctgggttttgtttgccacagcataatcgctgtcgccaaacggggtcatattacgcgtttctgaatacatggttgccaggtaaatattgttagcatcgtattttagcccagcagtccacgcgtctgctttatcaccacccgccgcagtatggttaacctggtcattggtgcggtcagaagaggtgtatgccgcaccagcgctaaagcccatgcctaaatcatatgttgtggaaagaccccagccgtcaccgttttcatggcgaacatcacgtccgttgttggtgccttcctgaccattactggctccttcgttgttaccttgatactgcaccgcgaagttcagaccatttaccagaccgaagaaatcagtattacgataagtcgcgacgccattggctcgaccagtcataaagttgtctgcattggtataagagtcaccgccaaattcaggcagcatatcggtccagccttcgatgtcgtacattacgccataattacgtccgtaatcgaaagaaccgtaatctgcaaatttcagcccggcaaatgccagacgggtccatgactggttttttgaagattcagtgttgtttgcctgaatattgtattcccattgaccgtagccagtgagttgatcgttaatttgggtttcgcctttaaaacccagacgcgcatagctctggtcgccatctttcgctgaattatcagaaaaataatgcaggccatcaactttgccatacagatctaatttgttgccgtctttattataaacttcggctgcatgtgcagcacctgcggcgagcagggcaggaattaaaagtgccagtactttgcttttcattgaataaatcctttagttattttatttgccttttatccccatttcggggagtgaaaacatcctaaaggagaagttcagttagccgataaatatcatttgttacgccttaagtaaaaccttaatcaaataattcctctgaaatgataataagtctggtgaatgtatcgaagataatacatacaaaataaaaattatacttttaatttgctatacgttattctgcgcgggttatatgcctttattgtcacagattttattttctgttgggccattgcattgccactgattttccaacatataaaaagacaagcccgaacagtcgtccgggctttttttttagaattggataatccttatccagagcatttaatcggtgttgcttttttccgcttttccggccatttgtgccaggaagtcatagcgtttttgcaaatcagctgcagcatctttccataactgttctgccacttctggctgctgcgaattcagccgacggaaacgttgctcgtgaagtaacgtttcttccggtgcttctgacggcgggcgtgaatccaaggccagcggcagtttgccttcatcggcacgacgcggatcaaagcgatatagcggccagaagccggtagctgtgagttggcgcatctggtcgtggctgagtgccagatcgtaaccatgctcttcacacgggctataagcaatgatcagcgatggccccggatacgcttccgcttcctgaatcgctttcaccgtctggttcagctgcgcgccgagagaaatctgcgccacataaacatgaccgtacatcatcatactgacgccaagatctttacgcgctttacgtttgccgtgctcgccaaatttagttactgcacccagcggtgtcgctttcgacgcctgaccaccggtgttggaatagcattgcgtatccagcaccagaatgttgacgttttccgtcaaactcaatacatgatccagaccgccaaagccgatatcgtaagcccagccatcaccaccaatcagccagattgatttttccaccagtgcatctgcatcacgtagcagttcatgtgcttcggcaacatcgttgagttgctggcgtaaagctgcaacctgttcacgacgaacctctggcgtggcgtctgatttcaacgccgtcagtaattccgccgggattttatcggcaaattgatccagcagacgcagcacgcggacacggtgttgatcgaccgtcaggcggaaaccaaggccaaattcggcattatcttcaaatagagagttcgcccatgccggcccacgaccgttggcatcggtggtatacggtgtagagggcaggttaccgccataaattgaagaacagccagtggcgttagcgatcaacatccggtcgccatagagctgagtcagtaatttaatatacggcgtctcgccacaaccggagcaagcacctgaatattcaaacagcggtgtaatcagctgcgatgtacgaatatcaatacgttccagtttgctacggtcgatttctggcaggttgaggaagaaatcgtaattgattttctcttcttcgacatgttccaggcgagacatcatattgatggctttaatctctggattctgacggtctttcgccgggcaaacttcgacgcacaggttacaaccggtgcaatcttccggtgccacctgcaagacatatttctgcccgcgcatatcacgcgatttcacatccagcgaatgcaggctggcaggggcgttttccatcgcttcaggcggcaccacttttgcgcgaatagctgagtgtgggcaagcggcaacgcagtggttacattgggtacagagttcctctttccagatggggatctcttcggcgatattgcgtttttcccagcgcgtagtgcccatcggccaggtgccgtctggcggcagcgccgaaacggggagggcgtcaccaagcccggcgagcatcgcagcggttacggttttcacgaaatcaggggcggcatcggaaaccactggcggtcgattggcgctgtgcggatttaccggttgcaacggaacttcttctacggattcacgcgccagcgccagagcctgccagttgcgttccaccagatcctggcctttgctactgtaacttttggcaatcgcaccctgcaattctgcgagggcgctatcgccaggcagaatttgcgtcagatggaaaaaagccatctgcatgacggtattaatacgggccgccaggccacattcgcgggcgattttcgccgcgttaatcacatagaagcgcgcttttttctggtttaacacggcctgaacttcttgcggcaagcgcgaccacacttcatctgcgctgtacggcgtgttgagcaggaaaatgccgccaggttttaaacgctcagccatctgatatttatcgataaactgcaactggtggcagccaacaaaatcagcctgggaaatgagataagcggaacgaatcggctgttcgctcactcgaaggtgagaaaccgtcaggccgcccgcctttttggagtcgtaaacaaaatagccctgtgcgtaccacggcgtggaattaccgataatcttgatattgtttttggtcgcggaaacgctgccatcactaccaaggccataaaacaaggcttccagtttcgccgagtttggcagggtgttttccggcaacggcagtgacagattggtcacatcatcgtaaataccaaccgtaaagcgcgctttcggtttagccgcgttgagctcggcaaataccgccagtacacagtctgggccaaattctttggatgaaagaccatagcgcccaccaatgacacggggcagagtttcgcgctcgccattattaaaggcttctgccagtgcggtcattacatccagatagagcggttctgcctgggcaccgggttctttggttctgtccagtaccgccacgctgcgtacggatcccggcagagcttgcagtaaatgtttagcggagaaggggcggtacaggcgaactttcagcacgccaactttttcgccacgggttagcaattcatcaaccacttcttcacaggtgccaatggcagagcccatcaggataatcacccgttccgcttgcggatgcccgtaatattcaaacggctgatactgacgacctgtcgcggcagagaaatcattcatcgcctgttcaacatggtcatagaccgcgttgtaccatgggttggtggcttcgcgagactggaaataagtgtcaggattggcggacgtaccgcggatcaccggatgttccgggttgagtgcccgggcgcgatgagcatcaatttcgacctgcggcatgagatcaagaatcgtgtcatcggccagcgggacaattttattgatttcgtgggacgtgcggaaaccatcaaagaaatgaataaatggcacgcggcttttcagcgtcgcgatttgcgaaatgagagcaaagtcttgcgcttcctggacgtttgctgcacacaacatcgcgcaacccgtctggcgcaccgccataacgtcggaatgatcgccaaaaatagagagtgcatgtgtggcaacggtacgtgccgctacatgcaggacaaacggtgttagttcgcctgccagtttgtacagcgtcgggatcatcagcagcaaaccctgcgatgacgtaaacgatgttgaaagggcacccgtctgcaaagcgccatgcacggtagcgatagcacccgcttccgactgcatttcaaccacgcgtggtgtgtctccccaaacgttctttaagccgtttccggcccaggcatcagcctgttctgccatcgtggaactgggggtaatagggtagatggcgataacttcactggtgcgaaatgcgaccgaagcaaccgcgccattaccgtcaatagtaatcatatgacacccttacattgcgcaaatgaggggcgcacgaaattgctgcgcgcccagtagtaatctttcaattttagcaaatggctttcttctgcattttcgcttttgtgtcccccacatcagcgtaatgaatgttttgatcaaacagagggcaaaaaaatagccataaaaaagtaaaaatgcggggcaacgcgcaggacagctctcgacgccgccctctgtgctgcctattatttatggcggtgtcgtttggcttgaagatcagaggaagaaaagatgcgagcagcgttttgggtagggtgtgccgctttattgttgtcggcgtgtagtagtgaacctgttcagcaggcgactgccgcgcacgtagcgccaggtttaaaagcgtcgatgtccagtagtggagaagcaaattgtgcaatgatcggcggttcgctttctgttgcccgtcaactggatggtacggcgattgggatgtgtgcattacccaacggcaaacgctgtagcgaacagtcacttgccgccgggagctgtggcagctattaattcattaaatccgccagcttataagttaatgtctgttttgcggtcgccagcgttaactggttcgcggtcagatccacttgtgcaccttctttcagcatttcgctaatggtgttatcgagttcattaagctgcgggttagcgcacatcatacgggtcattgccagccctttggctgtcagttcaccattagacagtttgccttcaccgctaaagcggttacacatgctgccggaaatcatcattttttcaccaaagctgatttctggcggatttttatcgctggtcacgggcttaccgtttacgctttccagcacaaagcgatgatgctgtagctgttctggcgtaacagcaattttgtcattacttacacatcccgccatcagcaggcttagcgcaacaaacgcggctactttcttcattgtggttctcaattacagtttctgactcaggactattttaagaatagaggatgaaaggtcattggggattatctgaatcagctcccctggaatgcaggggagcggcaagattaaaccagttcgttcgggcaggtttcgcctttttccagattgcttaagttttgcagcgtagtctgagaaatactggtcagagcttctgctgtcaggaatgcctggtgcccggtaaacagcacgttgtggcaggcagacaggcgacggaatacgtcatcctggatcacgtcgttggatttatcttcaaagaatagatcgcgttcgttctcatacacgtccatacccaacgaaccaattttctgatttttcagcgcttcaattgctgcctgagaatcaatcaatgcaccgcgactggtattgacgatcatcacgccatttttcatctgttcgaaggcggcttcgttcaacagatgatagttttccggtgtcagcgggcagtgcagagagataacgtctgattcagagaacagggttggcagatcgacatactccacaccgagttccagcgccgctgcacttggatacggatcgaacgccagcagacgcataccaaaacctttcagaatgcgcagcatcgccacaccgattttaccggtaccgataacgcctgccgttttgccatacatagtaaagccggtcagaccttccagagagaagttagcatcacgggtacgctgatacgcgcggtgaatacggcggttcagcgtcatcatcataccgatggcgtgttcagcaacggcctctggatcataggctggaacacggactactttcagccccagttcttttgccgcgtcaaggtcgacgttattgaaaccggcacagcgcagggcgatatatttaacgccgtgctttttcagctcttccagcaccgggcggctgccgtcatcgtttacgaaaatacataccgcttcgcagccattggcagttttagcggttttttccgtcagcagaaagtcaaaaaattccagctcaaagccaaaggactcgttcacctgttgcaggtacttcttgtcgtactgttttgtgctataaacggcgagtttcataagactttctccagtgatgttgaatcacatttaagctactaaaaatattttacaaaatttcaaatttaattgaaagctatggcgatattgaaaaattcatcaacaactatgcttagtgtaggcgcaaccttcaactgaacggttaaacatgccacaatacccgtattgaatgcttaatttttcgctaaatcaggatattaactacccatgctgggtaaatataaagccgttctcgcgctgttattactgattattcttgtgccgttgacgctgctgatgacgctcgggctgtgggttcccacgctggcgggcatctggctaccgctcgggacacgtattgcattagatgaaagcccacgcattacgcgtaaaggtttaatcattcccgatctccgttatctggtgggagattgtcagcttgcgcatatcaccaacgccagcctttcacatcccagccgctggttattgaacgtcggcacggtagaacttgattctgcttgtctggcgaaattgccgcagacggagcaatcgccagccgctccaaaaacactcgcgcagtggcaggccatgctgcctaacacctggatcaatatcgataaactgattttttctccctggcaggaatggcagggaaaactctctctcgcattaacctctgatatccagcaactgcgttatcagggcgaaaaagttaaatttcaaggccagctgaaagggcaacaacttacagtcagcgaactggatgtcgtcgcgtttgaaaatcagccgccggtaaaactggtgggggaatttgctatgccgctcgtgccggatggacttcctgtaagtgggcatgctactgcgacgttaaacttgccgcaggaaccgtcactggtggatgccgagctggactggcaggaaaatagcgggcaattgatcgtgctggcacgggataacggcgatccgttgctcgatttgccgtggcaaattactcgtcaacaattgaccgtaagcgatggtcgctggagctggccgtatgcaggttttcctttgagtggccgactgggtgtcaaagtcgacaactggcaggcagggcttgagaacgctctggtcagcggacgactgagtgtgctgacccaggggcaagcgggtaagggcaacgcggtgcttaattttggcccaggaaaattaagcatggataacagtcagctgcctctgcagctgaccggtgaagcgaaacaggcggacctcattttatatgcccgtttacctgcgcagctaagtggaagtctgtctgacccaacgctgacctttgagccaggcgcgttacttcgttcaaagggaagagtcatcgattcgctggacatcgatgaaatccgctggcctttagcgggtgtaaaagtcacccaacgtggtgttgacggacgtttgcaggccatcttgcaggcgcatgaaaatgaactgggcgatttcgtgctgcatatggatgggctggcgaatgattttctccctgacgctggccgctggcagtggcgctactggggaaaagggagttttacaccgatgaatgccacctgggatgtcgcaggaaaaggtgagtggcatgacagcacgattacgctgaccgatctctccaccggtttcgaccagttacaatacggtacgatgacggtagaaaagccgcgattaattctcgacaagcccatcgtctgggtacgtgacgcacagcatccctcctttagcggcgcgctgtcactggacgccgggcaaacgctgttcactggcggcagtgtgttaccgccatcaaccttaaaatttagcgtcgatgggcgcgatcctacctatttcctctttaaaggcgatttacatgctggtgagattggcccggttcgggtaaatggtcgctgggacggtattcgtctgcgcggtaacgcctggtggcctaaacaatcactgaccgtattccagccgctggtgccacccgactggaagatgaacttacgcgatggtgaactgtatgctcaggttgcattttctgctgcgcctgaacaaggattccgcgcgggaggacacggcgtgttgaaaggcggtagtgcctggatgccagataatcaggttaacggtgtcgattttgtcctgcctttccgttttgccgatggagcctggcatctggggactcgcggccccgttacgttgcgaattgccgaagtgattaatctggtgacagcgaaaaatattacggctgatttgcaagggcgttatccgtggactgaagaagaacccttgctgttgactgatgttagcgtcgatgtgttaggcggtaacgtactgatgaaacaattacgtatgccgcaacatgacccggcgctgttgcggctgaataatctctcatccagcgaactggttagcgccgtcaatccgaaacaattcgccatgtccggggcatttagtggtgcactgccgttatggctgaacaatgaaaaatggattgtgaaagatggctggctggcgaatagcgggccgatgacattgcgactggataaagacactgcggatgcggtggtaaaagacaatatgactgcgggttcagcaattaactggttgcgctatatggaaattagccgttcatcgacaaaaattaatttagataatctcggtttattaaccatgcaggccaacattacaggtaccagtcgcgttgatggtaaaagcggtacggtaaaccttaattaccatcatgaagagaatatttttacgctgtggcgcagtttacgctttggcgataatctccaggcatggctggagcagaacgcacgtctgccgggaaatgactgtccgcaaggaaaagagtgtgaggaaaaacaatgaaaattttactggctgcgttgacgtcatcttttatgctggttggctgtacgcctcgcattgaagtcgctgcacctaaggaaccgatcactatcaatatgaacgttaaaattgagcatgagatcatcatcaaggcagacaaagatgtcgaagagctgcttgaaactcgtagcgatcttttctgaggtgatgatgaagaaaacattacttctttgtgcgtttcttgttgggctggtaagcagcaatgtaatggcattgactctggatgaagccagaactcaggggcgggtaggtgaaacattttacggttatctggttgcgctgaaaacggatgctgaaacagagaaattagtagccgacattaatgccgaacgtaaagcgagttaccaacaactggcaaagcaaaataatgtgtcggtagatgatatcgcgaaactcgccgggcaaaagctcgtagctcgggccaaaccgggggaatatgtacaagggataaacggtaaatgggtgcgaaaattttaatagcaaaaccgcaatatcgggataacgctacaggagaaggcgattgatctattttcctgaaacaaggtgaatattcaaaaactcctgtcaaattgccttttgccctgaaaaatgcatagtcaaatatctgttttaactaattggcgttgcagtacatgcaacgccaattagttagcggaatttacgtcgatactcgcctggcgtcatcccaaagcgttgcttaaataccgttgaaaaatgactctggtcagaaaatccccaatgaaagccgatgcctgccagtttttcatcatctgcggcatggcgaatcgcatctgcacaaaaatcgagacgacggttacgaatatattgcgcgactaccaaacctttatcggcaaacattcggtacaaactacgtactgacatacctgtctctccggctatccactccgggcgtaatatctcttcgcgaatattatcgtctatcaacgtaaccactttttgaaactgacgttcacgacgaggttgaacagattcccgctgatgaagtaccgggcgcagcagacacaccatcgcctgtagcgcagcttcactttctgtttcagaaagtgccggattattcatgctctcctgtaacaggcgatgactgagttgcaccatgggtaagtcagcgtccagtctttctgcgcagataggtttttgatggggaaaatattgttccagcagagtgcgtggcaaaagtaatgaaatctgtttagaagactcctgccagtaaagcgaacaggggcgtgaggcatcgagtaacgtaatatcgccagcgccaatctgcacctgacgctcatcctgctccattattgcctgaccactaagctgaaaaacggtgtaaaaccaggcatcgtcgctgccttttacttcctgccaggtgcgggataaattcaccccgctggttgtcacggtactcagctttagtcctttggcaaaatgcgtgtccagtacacccgtgtaacgctcagtcagcaggcgtccggtaaaatttccgcatacctgattgatttgggaaagccattgctgaaactcattatccactgcggggttcatggcacgttttcgctctgtgaaatgtatttttattgttgcatttgtgttgcaataaacgaagctaatgagcctgactataggaaataagtcttgtcaggcatagagacataagcggttattgtcacgatttgcggagcttgtcacagctgacaaagcgaatgtcacagcgaaaaaagtgacttttcttgtcgctgcgtacactgaaatcacactgggtaaataataaggaaaagtgatgacagagccgcatgtagcagtattaagccaggtccaacagtttctcgatcgtcaacacggtctttatattgatggtcgtcctggccccgcacaaagtgaaaaacggttggcgatctttgatccggccaccgggcaagaaattgcgtctactgctgatgccaacgaagcggatgtagataacgcagtcatgtctgcctggcgggcctttgtctcgcgtcgctgggccgggcgattacccgcagagcgtgaacgtattctgctacgttttgctgatctggtggagcagcacagtgaggagctggcgcaactggaaaccctggagcaaggcaagtcaattgccatttcccgtgcttttgaagtgggctgtacgctgaactggatgcgttataccgccgggttaacgaccaaaatcgcgggtaaaacgctggacttgtcgattcccttaccccagggggcgcgttatcaggcctggacgcgtaaagagccggttggcgtagtggcgggaattgtgccatggaactttccgttgatgattggtatgtggaaggtgatgccagcactggcagcaggctgttcaatcgtgattaagccttcggaaaccacgccactgacgatgttgcgcgtggcggaactggccagcgaggctggtatccctgatggcgtttttaatgtcgtcaccgggtcaggtgctgtatgcggcgcggccctgacgtcacatcctcatgttgcgaaaatcagttttaccggttcaaccgcgacgggaaaaggtattgccagaactgctgctgatcacttaacgcgtgtaacgctggaactgggcggtaaaaacccggcaattgtattaaaagatgctgatccgcaatgggttattgaaggcttgatgaccggaagcttcctgaatcaagggcaagtatgcgccgccagttcgcgaatttatattgaagcgccgttgtttgacacgctggttagtggatttgagcaggcggtaaaatcgttgcaagtgggaccggggatgtcacctgttgcacagattaaccctttggtttctcgtgcgcactgcgacaaagtgtgttcattcctcgacgatgcgcaggcacagcaagcagagctgattcgcgggtcgaatggaccagccggagaggggtattatgttgcgccaacgctggtggtaaatcccgatgctaaattgcgcttaactcgtgaagaggtgtttggtccggtggtaaacctggtgcgagtagcggatggagaagaggcgttacaactggcaaacgacacggaatatggcttaactgccagtgtctggacgcaaaatctctcccaggctctggaatatagcgatcgcttacaggcagggacggtgtgggtaaacagccataccttaattgacgctaacttaccgtttggtgggatgaagcagtcaggaacgggccgtgattttggccccgactggctggacggttggtgtgaaactaagtcggtgtgtgtacggtattaatctggttcgctcataagtaaaaaacggcacctggtgccgtttttttgtctgaaacaatcacttatctttcttcagcgcccctagcgttggcgtttcgtcaaagaagttccatggtttcagcagagtatgtacccattcggtcggcataatcggccactcttcggcgcgggccacatgtgtggtgccggtggtcatccagacaacggcgtcggtgttgtccagcgactcgttatccttactgtattgtccaagaccggtgtcatgagtagaacggttcggatatttgccttccgggaaacgctcgccaggatgataacgcgttacccagagctgcttgtccataaagcttaaacgatgatagatccactcgtccggcgcgaactgggcaccttttgctaccgggtgagtaccacctgcataaggaataatttgataggaaaccggattgcccatgcggttctctttgttcgggttactcaacagacgaatcgtgcccggatcaaatttctgtgcggcatcctgttcattgccgatgttgtactgattaacttgcatggtactggtgcgtgggccaccggcagtattcggttttaccactgggtccatcgccaccaggctgttattctcgccatctacatccagatcgaggcggaaattataaatatgttggtgtgtagtacccacgatattgtgatcgataagcgtgccgtagcgcgtgtcatctttcgccgtctcatcgtgcatggttttcgctttaacacctttcaccgcttcgatgcccgtagcaccggcatcgatgccaatagtgccgttttcatggaagatccagtcaaaaatgtagtcatagttacccactgtactgatccagcgcaccactaactcccggcgttcggtactgacgttgggctggcccatttcctgatgcttatactccggcccggcataacgttcaaataccgcgatagcgcgagggatctccatcggcacgccagtgtagtcggcgatggtttcattaaggagcactgcgttagacggggcatctttaccacgagcaattggtgaggttagcgtgcccataccgtagtcaccagagtccagatacgctttaaagtaccagccaatatcaggatcaccgtaaggcacaatcatgccgccgagagaaccttcgtacatgactttgcgtttggtgccattgtcgttataagtcacggtggagatcatcggcccgacgcgagagttcatgctgaggtgaaaatcccagttccgccagtgaatcatatcgccagtaatggtgtaatttttaccttcaggctcaatgatttgcataggcttaactgccggagcaacgcggtcacggccatcaaatgggcgtgcggtcattggcaccggaactaccggaccttcttcaatcttaacgatttttttctgttctaaatcaacgaccgccaccaggttttcgatgggatgtgcccagtagttgccatcaccgacatcaagatagctgatgactttgagcaaccgggcatcttgtttcaggccatctttaccatcgaaataacctacggtcagcggcgtggtaatcacttttttcgcatcagtaataccgcgtttcttcacggcagcggcaaattcttcactgttgttaataatgttctgcacactggcgaaatcatccagcaacaccataccgtgggcgtctttaatgggttgccaggagagcagtttgttgttttgcagatccaccaccgcttcgatgatatgtttgccgtcgagcataatgacgtcggctttgcgcggctggtcaaccggtttgttttccagcgcaaacgcccagacagcttctttatctggcggtagcagggagatctcagtaaaacgggtattgggtttgaagtccgcggaagctttaacaatttcaacggcctgtttaatttcgtccgcagttagcgcattaagtgggtgagggcgcttttctacctgaaaggtttgatccagcccggactggaaaacatcgttaataaaggtgtcagaaacccaggctttattgtctttcatcactaccggtacttgcagtgccagaggctgaccattaacaattgctgtttgcgcaccaggcttcactttcacgtacgcgccatctttaatcagggtaaagagctgggcgtagtcgtcccactgcacatcggcaccaaattctttaagcgttttatccattggcaccatatgcgcttcaccaccgtgggcaaataccggcgcttgccaggcgaaacttaaggcgactgccaacgccagggttgttttacgggcagaatacagagaggggcttcccattattaacctcgtcagatgttgtgttcttgttagcaaccgcgctctgtgggcggtttagtcaggttcacattatcagtactgatgcaaaggggattgcctgcacctgccaggttgtttggcaggtgtgccagcttttcatacagtggatgccctgaaaatagatgtacacatcatgcataatgtgacaacgtcacaaaacttagtgaaataaaagggcaactattcgccgttgcccttcattcaccgattaatcgacaaaatcaccgtgctgcctggccaccagcgtcagaattgaatacagcgccaccggggtttgatgctgattgaatacctctacagcccattccaccacacctgttggtttttcttctgcgctacgctgttttttcagcgtcttgcgcttacaggtgagacgcacctggatggtatcgcctggctttacgggttcgataaaacgcaagctttccagcccgtagttagcaatgaccggaccgacaccggcatcgacaaacagacccgcagccgcagaaagcacaaaatacccatgcaccacccgctcaccgaaaatagattcggcagcagcaatcttatccatatgtgcatagaaatgatcgccgctgaggcaagcaaagttaacaatatcggcctctgtcattgtgcggcggggagtcaacaggctgtcgcctggttgtagctcctcaaaatatttgcggaacggatgaatacgatcttcttcgactttcgcaccgcgcacccactgtttactgatagcggcaagcatcgtcggactaccctgaacagcggttcgctgcatgtaatgtttcaccgctcgtaaaccgcctaattcttcaccgcctcctgcgcgaccaggcccaccatgtaccagttgtggcagtggggagccatgcccggtggattcttttgccgactcttcattgaggatctgaattcgcccatgcgtacgtgccgcgtcggcaataaactgacgcgcaatttgcggatcagccgtcaccagcgttcccgcaaggctaccgccgcctgcacaagccagttgcagagcatgtcgctggttttgtgctggcatcagcgttgcgacagggccaaaggcttctgttgcatgtaccgccggtgtttcatccggctgcggacagtacaataaggttggcgggaagaaggcacccgcagcagataaatccgcctgaccaccgaggcgaatctcgcatcctgcagccagcaatatgttcactttttcctgcacatcggcacgctgctcagcatttaccagtgcgcccattttcacgccttcctgagcaggatcaccgaccacgactttctgtaatcgcgcaaccagagcatcactgacagcattaaccaatgcctgcggcacaataatccgccggattgccgtacatttttgcccggcttttgtggtcatctcacgcacaacttcacgaataaacagcgcaaactccggttgatccggggtgacatcttcgcccagtacgcagcagttcagggaatcagcttccatagtgaaggggatagatttggcgacgatatttggctgaactcgcagcatctgtccggtcgccgctgaccccgtgaaagtcaccacatcctggctgtccagatgatccaacaagtcgccagcactaccgcagatcagactaattgcgccttcgggaacaagaccactatcgacaattgatttcaccatcgcctgagtcagttgggccgtcgcggtagctggtttgatgatggctggcattccgcccagccacgttggtgccagcttttccagcattccccagcaggggaagttaaaggcgttaatatgcactgccacgcctgactttgaggtcagtaaatggcgcgcggcaaatccaccttctttcgataaggggatcaattcatcttccggccacagcgtatcgtcaggcagctcccggctaccgaggctggcgtaagtaaataacgtcccaatgccaccttcaatatcaacccaactgtctgcccgcgttgcgcctgtttgcgcagaaagagcatagaaacgctctttttcactcagcagatgtttagcgaccgctttaagcatcgccgcacgttcgataaaggtcatagcgcgaagggcgggggcacctttttcaatggcaaactggcgggcagccgccatatcaagaccttcactggtcacttcccataacgcctcgccgctaatagcgtggtgaatcaaacggctacggccccggccagactgccaggtaccggataagaaactggctaactgctgcatcgctactctccagatgtttcacatttctgttgctaatagttaaatcgcgaatcataaaaagcaaaggatcttttaacgaaatgttaactatgcgatctgtatagcaactgcggaaaacattaatgcactgataaataatgatttataaaaatagggtgcgaaatccgtcacagttcaaacatacaaaatttgtgattttacttaactattgtgtaactttcataaaacaatgtgattcgtgtttttaattaattcacgaaaactggaatcgtaaaggtgatgacgtgacccaagaagaacgctttgagcaacggatagcccaggaaacggctatcgagccacaggactggatgcccgatgcttaccgaaagacattgatccgccagattgggcagcatgcgcactccgagattgttggtatgttgcctgaaggtaactggatcactcgcgcaccaaccttgcggcgtaaagccattctgttggccaaagtgcaggatgaagccggtcatggtctgtatctctatagcgccgccgaaacactgggctgcgccagagaagacatctaccaaaaaatgctcgacggacggatgaaatattcctccatctttaattatccgacattgagttgggctgatatcggtgttatcggctggctggtggatggcgcagcgatcgtcaatcaggtggcgttatgccgcacttcttatggcccgtatgccagagcaatggtgaaaatctgcaaagaagagagttttcaccagcgtcaggggtttgaagcctgcatggcactggcgcagggcagcgaagctcaaaagcagatgttgcaagacgccattaaccgtttctggtggccagccttaatgatgttcgggccaaacgatgataactcgccaaacagcgccagaagtctcacctggaaaatcaaacgtttcaccaacgacgaactccgccagcgtttcgtggataacaccgttccacaggttgaaatgctcggtatgaccgttcctgacccggatctgcattttgacactgaaagcggtcactaccgctttggtgagatcgactggcaggagtttaacgaagtaattaacggtcgcggaatttgtaatcaggagaggctcgacgccaaacgtaaagcctgggaagaaggtacctgggtacgggaagcagcgctggcccatgcacaaaaacaacatgcccgtaaggtcgcataaggagattcaaaatgagtaatgtttactggccgttatacgaagttttcgtgcgtggcaaacagggcttatcacaccgccatgttggcagtttacatgctgccgatgagcggatggcactggaaaatgcccgtgatgcttacacccgtcgtagcgaaggatgttcaatttgggtggtgaaggcgagtgaaattgttgcctcgcaaccggaagaacgcggtgaattttttgatccggctgaaagcaaggtctatcgccatccaacgttttacaccatccctgatggcattgagcacatgtgaggtcggaaatgaatcagttaacggcttacaccttgcgcctgggcgataactgcctggtgctctcccagcggttgggtgaatggtgcggtcacgcaccggaactggaaatcgatctcgcactggcaaacattggcctcgatttattaggtcaggcacgcaacttcttatcgtatgccgctgaattagcgggagaaggcgatgaagataccctggccttcacccgagacgagcgccagttcagcaacttattgttggttgaacaaccaaacggcaattttgccgacaccattgcacgccagtatttcatcgatgcatggcatgtggcgctctttacccgtctgatggaaagccgtgatccgcaactggcggcgatttctgccaaagcaattaaagaagcgcgctatcacctgcgttttagtcgtggctggctggagcgactgggcaatggtactgacgtatcagggcaaaagatgcagcaggccatcaacaagttgtggcgttttaccgccgaactgttcgatgccgacgagattgatattgcactgagtgaagagggtattgcggttgatccacgcactttacgcgcagcgtgggaagccgaagtttttgccgggatcaacgaagccacattgaacgtaccgcaagagcaggcgtatcgcactggcggtaaaaaaggactgcataccgaacaccttggacccatgctggcagaaatgcagtatctccagcgtgtcttgcccggtcagcaatggtaacagaggagatgggtatgcaacgtctggccaccattgcaccgccacaggttcatgagatatgggcgctactcagccagatcccggacccggagatcccggtgctgaccattactgatttaggcatggtgcgtaatgtgacacagatgggagaaggatgggtgatcggctttacgccgacatattccggttgtccggcaacggaacatttgattggcgcgatacgtgaggcaatgacaaccaacgggtttacccccgttcaggttgtgctgcaactcgacccggcatggaccaccgactggatgacccccgatgcccgtgagcgtctgcgagagtatggcattagcccgcccgccggacacagttgccatgcccatttgccgccagaagtacgttgcccgcgctgcgccagcgtccataccacacttatcagtgaatttggttccacggcctgcaaagcattgtaccgctgcgatagttgccgcgaacctttcgattatttcaaatgtatttgaggatgccatgacaacgtttcattccttaacagtggcaaaagtcgagtcggaaacccgtgatgcggtgaccattacctttgcggtgccccagcctttgcaggaggcgtatcgctttcgccccggtcaacatttgaccttaaaagccagctttgatggtgaagaattacgccgttgttactccatttgccgcagctatctgcctggcgaaattagtgtggcggtgaaagccattgaaggcggacgtttctcccgctatgcccgcgaacacatccgccagggtatgacgctggaggtcatggtgccgcaggggcatttcggctatcagccgcaggccgaacgccaggggcgctatctggcaattgcagcaggatcaggtattacgccaatgctggcgattatcgccaccactttacaaaccgagcctgaaagtcagttcaccctgatctacggtaaccgtaccagccagagcatgatgtttcgccaggcactggcagacctgaaagacaaatatcctcagcgtttacagttgttgtgcattttcagtcaggaaaccctcgacagcgatctgcttcacgggcgtattgacggtgaaaaattacagtcacttggggcctcgctcattaattttcgtctttatgatgaggcatttatttgtggtccggcggcgatgatggatgacgcggaaaccgccttaaaagcactgggaatgccagataaaaccattcatctggagcggtttaatacgcctggcacgcgcgtcaaacgtagcgttaacgtgcaaagtgacggacaaaaagtgactgtacgtcaggatgggcgggatcgggaaatcgtgcttaatgccgacgatgaaagcattctcgatgcggcattgcgccagggggcggatctgccctatgcctgcaaaggcggcgtctgtgcgacctgcaaatgcaaagtgctgcgtggcaaagtggcgatggaaaccaattacagtctggaaccggatgaactggccgcaggttatgtgttgagttgccaggcactgccgctgaccagcgatgtggtggttgactttgacgcgaaggggatggcatgagcgaactgatcgtcagccgtcagcaacgagtattgttgctgacccttaaccgtcccgccgcacgtaatgcgctaaataatgccctgctgatgcaactggtaaatgaactggaagctgcggctaccgataccagcatttcggtctgtgtgattaccggtaatgcacgcttttttgccgctggggccgatctcaacgaaatggcagaaaaagatctcgcggccaccttaaacgatacacgtccgcagctatgggcgcgattgcaggcctttaataaaccacttatcgcagccgtcaatggttacgcgcttggggcgggttgcgaactggcattgttgtgcgatgtggtggttgccggagagaacgcgcgttttgggttgccggaaatcactctcggcatcatgcctggcgcaggcggaacgcaacgtttaatccgtagtgtcggtaaatcgttagccagcaaaatggtgctgagcggagaaagtatcaccgctcagcaagcacagcaggccgggctggttagcgacgtcttccccagcgatttaaccctcgaatacgccttacagctggcatcgaaaatggcacgtcactcgccgctggccttacaagcggcaaagcaagcgctgcgccagtcgcaggaagtggctttgcaagccggacttgcccaggagcgacagttattcaccttgctggcggcaacagaagatcgtcatgaaggcatctccgctttcttacaaaaacgcacgcccgactttaaaggacgctaatgatggaattcatcctcagtcatgtagaaaagggcgtgatgacactaacgctcaaccgcccggaacgcctgaacagttttaatgatgagatgcacgcacaactggcagagtgcctgaaacaggtcgagcgcgacgacactatccgttgcctgttacttacaggtgccgggcgcggattttgtgctggtcaggatcttaacgatcgtaacgttgatcccacaggccccgcaccggatttagggatgtcagttgaacgtttctataacccactggtacgtcgcctggcaaaactgccaaaaccggtgatctgtgcagtcaatggcgtggcggcaggggcaggcgcaacactggcactggggggcgacatcgttattgctgcccgttcagcaaaattcgtcatggcgtttagtaagttaggcttaatacccgattgcggtggaacctggttactgccacgcgttgccggacgagcgcgcgccatggggctggcactgctggggaatcaactgagtgctgaacaggcgcacgaatgggggatgatctggcaggttgttgatgatgaaacgctggcagataccgcgcaacagctggcacggcatctggcgacacaaccgacatttggtcttggacttatcaagcaagcgataaatagcgctgaaaccaatacgctcgatacgcaactggatctggaacgtgactatcagcgacttgccggacggagcgcagattatcgtgaaggtgtcagtgcgttcctggctaaacgctcaccgcagttcacggggaaatagcatgatgataaatgtgcaaactgtggcagtgattgggagcggcaccatgggggcaggcattgctgaagttgctgccagtcatggacaccaggttttactgtatgacatttctgctgaagcgctgacccgcgcaatcgacgggatacacgcgcggctaaattcacgcgtgacgcggggaaaactgactgctgaaacctgtgaacgcacattgaaacgcctgatcccggtgaccgatattcacgcgctggcagctgcggacctggtcattgaagcggcgtctgaacgtctggaagtcaaaaaagcgctctttgcacagctggcggaagtttgcccgccacaaacgctattgaccactaacacttcgtcaatctctataaccgcgattgctgcggagataaaaaatcctgaacgtgttgcggggctgcatttttttaacccggcaccggtgatgaagttggtggaggtggtcagtgggctggcaacggcggcggaagttgttgagcagttgtgtgaactaacgttgagttggggtaagcagcctgtgcgctgtcattcgactcctggatttatcgttaaccgtgttgcgcgtccttattattccgaggcctggcgggcactggaagagcaggttgctgcaccagaagtgattgacgctgcacttcgcgatggcgctggtttcccgatggggccgctggaattaaccgatctgattggtcaggacgtcaattttgctgtcacctgttcggtgtttaacgctttctggcaggagcgtcgttttttaccttcgctggtgcaacaggaactggtgattggtggacggttgggcaagaaaagtgggctgggcgtgtacgactggcgcgcggaacgtgaggcagttgttggcctggaagcggtaagcgacagttttagcccaatgaaagtagaaaagaaaagtgacggtgtcacggaaattgacgatgttttattgattgagacacaaggcgagacggcacaggcgctggcaatacgactggcacgcccggtggtagtgatcgataaaatggcgggcaaggtggtgaccattgctgctgcagcggtgaacccggactcagcgacccgcaaggccatttattacctgcaacagcagggcaaaacagtgctgcaaattgcagattacccaggaatgctgatttggcgaacggtagcaatgatcatcaatgaagcccttgatgcgcttcaaaaaggcgtggcctctgaacaggatatcgataccgccatgcgtcttggggtgaattatccatatggcccacttgcctggggagcgcaacttggctggcagcgaatattaaggctccttgaaaatctacagcatcactatggcgaagaacgctatcgcccatgttcattgctgcgccaacgggcgcttctggagagcggttatgagtcataaggcctggcaaaatgcccatgcaatgtatgagaacgatgcctgcgccaaagcgcttggcatcgacattatctcaatggatgaaggctttgctgtagtgaccatgaccgtcactgcacaaatgcttaacggtcatcaaagttgccacggcgggcagctattttcactggctgatactgcctttgcctacgcctgcaatagccaggggctggcagccgtcgcttctgcctgcacgattgattttttgcgtccaggctttgccggagacaccttaactgctactgcgcaggtacgtcatcagggcaagcaaaccggtgtttacgacatcgaaattgttaaccaacaacaaaaaacggttgcgctgtttcgcggtaaatctcaccgcatcggcggcaccattacaggagaagcctgatgcgtgaagcctttatttgtgacggaattcgtacgccaattggtcgctacggcggggcattatcaagtgttcgggctgatgatctggctgctatccctttgcgggaactgctggtgcgaaacccgcgtctcgatgcggagtgtatcgatgatgtgatcctcggctgtgctaatcaggcgggagaagataaccgtaacgtagcccggatggcgactttactggcggggctgccgcagagtgtttccggcacaaccattaaccgcttgtgtggttccgggctggacgcactggggtttgccgcacgggcgattaaagcgggcgatggcgatttgctgatcgccggtggcgtggagtcaatgtcacgggcaccgtttgttatgggcaaggcagccagtgcattttctcgtcaggctgagatgttcgataccactattggctggcgatttgtgaacccgctcatggctcagcaatttggaactgacagcatgccggaaacggcagagaatgtagctgaactgttaaaaatctcacgagaagatcaagatagttttgcgctacgcagtcagcaacgtacggcaaaagcgcaatcctcaggcattctggctgaggagattgttccggttgtgttgaaaaacaagaaaggtgttgtaacagaaatacaacatgatgagcatctgcgcccggaaacgacgctggaacagttacgtgggttaaaagcaccatttcgtgccaatggggtgattaccgcaggcaatgcttccggggtgaatgacggagccgctgcgttgattattgccagtgaacagatggcagcagcgcaaggactgacaccgcgggcgcgtatcgtagccatggcaaccgccggggtggaaccgcgcctgatggggcttggtccggtgcctgcaactcgccgggtgctggaacgcgcagggctgagtattcacgatatggacgtgattgaactgaacgaagcgttcgcggcccaggcgttgggtgtactacgcgaattggggctgcctgatgatgccccacatgttaaccccaacggaggcgctatcgccttaggccatccgttgggaatgagtggtgcccgcctggcactggctgccagccatgagctgcatcggcgtaacggtcgttacgcattgtgcaccatgtgcatcggtgtcggtcagggcatcgccatgattctggagcgtgtttgagcatatcaacctgcgagtaccctacaatgataaccaatacaaagcttgacccgattgaaaccgcgtctgttgatgagttacaggcgttgcaaacacagcgtctgaaatggacgctcaaacacgcgtatgaaaatgtgccgatgtatcggcgcaaattcgacgcagcaggcgtacatcctgatgatttcagggaactttcagacctgcgtaaatttccctgtaccaccaaacaggatctgcgcgacaactatccctttgacacctttgccgtgccaatggaacaagtggtgcgcattcatgcttcttcgggaaccacaggtaaaccgacagttgtcggctatacgcaaaacgatattgataactgggccaatattgtagcgcgttctttgcgtgcggcagggggctcgcccaaagacaaaattcatgttgcctatggttacggcctgtttactggtgggctgggtgcgcactatggtgccgaacgtctgggcgctacggtgatcccgatgtctggcgggcagacggaaaaacaagcgcaactgatccgtgattttcaaccagatatgatcatggttacgccatcttattgccttaacctgattgaagagctggagcggcagttgggcggtgatgccagcggttgctcgctgcgggttggagtatttggtgctgagccgtggacacaggccatgcgtaaagagattgagcgtcgcctggggatcaccgcactggatatttatggcctgtcagaagtgatggggccgggggtggcgatggagtgtctggaaactaccgacggcccaaccatttgggaagatcatttctatcctgaaattgttaatcctcatgacggcacaccgcttgccgatggtgaacatggcgaactgttattcaccacgctgaccaaagaagcattgccggtcattcgttaccgcacgcgtgatttaacccgactgttaccaggaacggcgcggactatgcgccgcatggatcgcatcagcggacgcagcgatgacatgttgattattcgcggtgtaaatgtctttccgtcacaactggaagaagagattgtcaaattcgaacatttatcgccgcattaccaactggaggtgaaccgccgggggcatcttgattcactttctgtgaaagtggagttgaaagaaagtagcctgacattgacgcatgagcagcgttgccaggtatgccaccagctgcgccatcggattaagtcgatggtggggatctctaccgatgtgatgatcgttaactgtggcagtatcccgcgttcagaaggcaaggcgtgtcgggtgtttgatctgcgcaatattgttggtgcctgacgtatcgtctggccctggtggggtaaagcgccagggccagaagtcgatacgacctgtgctatgattcataaatcacaacaataacaacagactgaagcgaatgagtaaacttgatacttttatccaacatgctgtaaacgctgttccggtcagtggcacatctttgatctcctctctgtatggtgattcgctttcccatcgtggtggtgaaatctggttgggtagtctggctgctttgctggaagggctgggatttggtgagcgtttcgtgcgcaccgctttgtttcgtcttaataaagaaggctggctggatgtttcccgcatcgggcgacgcagtttctatagcctcagtgataaaggcttgcgcctgacgcgacgggcagaaagtaaaatttatcgcgcagagcaacctgcatgggatggtaaatggctcctgttgctctcggaaggtttagataaatcaacgctggctgatgtcaaaaagcagttgatctggcaaggttttggcgcactggcacccagcctgatggcatcgccgtcgcaaaaactggccgatgtacagacacttttgcatgaagcgggtgtggcggataacgtgatttgttttgaagcgcaaataccactggcgctttctcgcgcagcactgcgtgccagagtagaagagtgctggcatttaactgaacaaaatgccatgtacgaaacctttattcagtcattccgcccgctggtgccgcttttaaaagaggcggcagacgagttaaccccggagcgggcatttcatattcagcttttactgatccatttttatcgccgtgtcgtccttaaagacccattgttgccggaggagttgcttccggcacactgggcagggcatacggcgcgtcagctgtgtatcaacatttatcagcgcgtagcgcctgctgctttagcgttcgttagtgaaaaaggtgaaacctcggtcggtgaactgcctgcgccgggaagcctgtattttcaacgttttggcggcttgaatattgaacaggaggcgttatgccaatttatcagatagacggtctgactccggttgtgccagaagagagttttgtccatccgacagcggtattgatcggcgatgttattctcggcaagggcgtttacgttgggccaaatgccagcctgcgtggcgattttggtcgtatcgtggtgaaagatggcgcgaacattcaggataattgcgttatgcacggttttcccgagcaggatactgttgtaggagaagatggacatattggtcatagcgctatccttcacggctgcattatccgccgcaatgcattagtgggaatgaacgcggtagtgatggacggtgcggtgattggcgagaacagcattgttggtgcatccgcatttgtgaaagccaaagcagaaatgccagctaattacctgattgtcggcagcccggcgaaagcgattcgtgaactcagtgagcaggagttggcatggaaaaagcagggtacgcatgagtaccaggtgctggtgacacgctgtaagcagacgttacatcaagtcgagccattgcgggaaattgaacctggcaggaaacgcctggtatttgatgagaatctgcgaccgaaacagtaacagatgtaaaattattttgtccctttaattataaagcagagttatgtttaagctctgctttatttatttgagtattaattcataccgttttttcatcatataattatttataatgagaatgtggttttaatttgtaatttatattatatacacaatttatatatttcatggtctttttttattcacctgaattataattgtgaattataggaaagtatgtttgattagataataatctactggcaatattggatgtcttctatgttttaaataactaattggtcgggttagtgcatccggctttctttatattcgccagaaggatttattatgcaaaggaaaactctattgtcggcctgtattgcattagctctgagtggtcagggttgggcggcagatatcacagaggtagaaaccaccacaggtgaaaagaaaaataccaatgtgacttgtccggcagacccaggaaaactcagtccggaagagcttaaacgcttaccctctgaatgctctcctttagtcgaacaaaacctgatgccatggctttccacaggcgctgctgcgttaatcacggccttagccgtagtggaactaaacgacgatgatgatcatcatcatcgcaacaattctccactcccaccgacaccccctgatgatgaatcagacgacactccagttcccccaactcctggcggagatgagataataccggacgatccggatgatacgcctacacctcccaaaccggtttcgtttaataatgacgttattctcgataaaacagaaaaaacgttaactattcgcgattcagtttttacttataccgagaatgctgacgggactatatctctgcaagatagcaatggtcgtaaggcaacgattaatctttggcagattgatgaagcgaataacactgttgcccttgaaggggtgagcgcagatggcgcaacgaagtggcaatataatcacaacggtgagcttgttattacgggtgataatgccacagtaaacaacaatggcaaaaccaccgttgacggtaaagattccaccggtacggaaatcaacggtaataacgggaaagtgattcaggacggcgatctggatgtcagcggcggcggtcacggtattgatatcaccggtgacagcgcgacggtggataacaagggcaccatgaccgtcaccgatccggagtccatgggtatccagatcgacggtgacaaggccatcgtcaataacgaaggcgagagcaccatcaccaacggtggcaccggcacccagattaatggtgatgacgccacggcaaacaacaacggcaaaaccaccgttgacggcaaggattccaccggtacggaaatcaacggtaataacggaaaagttattcaggacggcgatctggatgtcagcggcggcggtcacggtattgatatcaccggcgacagcgcaacggtggataacaagggcaccatgaccgtcaccgatccggagtccatcggtatccaggttgacggcgaccaggcggttgttaacaacgaaggcgagagcgccatcaccaacggtggcaccggcacgcagattaacggtgatgacgccacggcaaacaacaacggcaaaaccaccgttgacggcaaggattccaccggtacggaaattgctggcaataacgggaaggtgattcaggacggcgatctggatgtcagcggcggcggtcacggtattgatatcaccggcgacagcgcaacggtggataacaagggcaccatgaccgtcaccgatccggagtccatcggtatccagattgacggcgaccaggccatcgtcaataacgaaggcgagagcactatcaccaatggcggcaccggcactcagatcaacggtaacgacgccaccgcgaataacagtggaaaaaccactgttgatggaaaagattccacgggtaccaaaatcgcgggcaatatcggcattgtaaatctggatggtagcctgactgttacaggcggtgcgcatggtgttgagaacattggtgacaacggcacggttaacaacaaaggagatattgttgtttccgatactggatcgattggcgtgctcatcaacggtgagggggcaacagtatccaatacgggtgatgttaacgttagcaatgaagcgacagggttcagcatcacaaccaacagtgggaaggtttcgctggcaggcagtatgcaggttggcgatttctcgaccggggtagatcttaatggcaacaataacagcgtgacgctggcggcaaaagatctaaaagtggtcgggcagaaagcgacgggcataaacgtttctggcgatgcgaatacagtgaatatcactggtaacgttctggttgataaggataaaaccgcagacaatgcggcggaatatttcttcgatccatccgtgggtatcaacgtttacggcagtgataataacgtgacgctggatggaaagttaactgttgtatcagacagtgaggttacttctcgtcagagtaatttatttgatggcagcgcagagaaaacgtcaggtctggttgtgattggcgatggcaataccgttaatatgaatggtggacttgaactgattggagagaaaaacgcgcttgcagatgggtcgcaggttacttccttgcgcacaggatatagttataccagcgttattgtcgttagtggtgagtcgtcggtatatctgaatggagatacgacaatcagcggagaattccctctggggtttgccggggttattcgggtacaggataaagctttgctggaaattggcagtggcgctacgctaacaatgcaggatattgacagttttgaacatcatgggacaagaaccctggatttgcccctatatttccagacatctgttatcacttaacccattacaagcccgctgccgcagatattcccgtggcgagcgataacccagcgcactatgcggatgccattcgttataatgctcgaacgcctctgcaaggttctttgctgccgttaacccgtctggtttgggcatgatactgatgtagtcacgctttatcgttttcacgaagctctctgctattccgttactctccggactccgcaccgccgtgttcttcggttcaagtcccaacatccgggcgaactggcgtgtttcattagcccggtagcatgaaccattatccgtcagccactccactggagacgacggaagatcgttgccgaagcggcgttccaccgctcccagcatgacgtcctgtactgtttcactgttgaagccgccggtagtgaccgcccagtgcagtgcctcacgatcacagcagtccagcgcgaacgtgacacgcagtctctctccgttatcacagcagaactcgaacccgtcagagcaccatcgctgattgctttctttcacggccactctgcctgtatgtgcccgtttcgatggcggtacagcaggttttcgctcaagcaacagcgcattctggcgcatgatccggtaaacacgtttggcattgatcgcaggcataccatcaagttctgcctgtctgcgaagcagcgcccatacccgacgataaccatacgttggcagctctccgataacatggtgtatacggagaagcacatccgtatcatcagtgtgacgactgcggcggccatccatccagtcatcggttcgtctgagaatgacgtgcaactgcgcacgcgacacccggagacaacggctgactaagcttactccccatccccgggcaataagggcgcgtgcgctatccacttttttgcccgtccatattcaacggcttctttgaggagttcattttccatcgttttcttgccgagcaggcgctggagttctttaatctgcttcatggcggcagcaagttcagaggcaggaacaacctgttctccggcggcgacagcagtaagacttccttcctggtattgcttacgccagagaaataactggctggctgctacaccatgttgccgggcaacgagggagaccgtcatccccggttcaaagctctgctgaacaattgcgatcttttcctgtgtggtacgccgtctgcgtttctccggccctaagacatcaatcatctgttctccaatgactagtctaaaaactagtattaagactatcacttatttaagtgatattggttgtctggagattcagggggccagtctaaaccccagaacttacttatgctgattccggtgcgaaaattgttaataaaggtacttgtagattcaattggtcaacgcaacagttatgtgaaaacatggggttgcggaggttttttgaatgagacgaacatttacagcagaggaaaaagcctctgtttttgaactatggaagaacggaacaggcttcagtgaaatagcgaatatcctgggttcaaaacccggaacgatcttcactatgttaagggatactggcggcataaaaccccatgagcgtaagcgggctgtagctcacctgacactgtctgagcgcgaggagatacgagctggtttgtcagccaaaatgagcattcgtgcgatagctactgcgctgaatcgcagtccttcgacgatctcacgtgaagttcagcgtaatcggggcagacgctattacaaagctgttgatgctaataaccgagccaacagaatggcgaaaaggccaaaaccgtgcttactggatcaaaatttaccattgcgaaagcttgttctggaaaagctggagatgaaatggtctccagagcaaatatcaggatggttaaggcgaacaaaaccacgtcaaaaaacgctgcgaatatcacctgagacaatttataaaacgctgtactttcgtagccgtgaagcgctacaccacctgaatatacagcatctgcgacggtcgcatagccttcgccatggcaggcgtcatacccgcaaaggcgaaagaggtacgattaacatagtgaacggaacaccaattcacgaacgttcccgaaatatcgataacagacgctctctagggcattgggagggcgatttagtctcaggtacaaaaaactctcatatagccacacttgtagaccgaaaatcacgttatacgatcatccttagactcaggggcaaagattctgtctcagtaaatcaggctcttaccgacaaattcctgagtttaccgtcagaactcagaaaatcactgacatgggacagaggaatggaactggccagacatctagaatttactgtcagcaccggcgttaaagtttacttctgcgatcctcagagtccttggcagcggggaacaaatgagaacacaaatgggctaattcggcagtactttcctaaaaagacatgtcttgcccaatatactcaacatgaactagatctggttgctgctcagctaaacaacagaccgagaaagacactgaagttcaaaacaccgaaagagataattgaaaggggtgttgcattgacagattgaatctacactgttgaaattcagaatttaggttttgcttttgttactggtgaaaatacaacaggtataaatagtggcacgatctcgttattacaaaatggtaaagatccggcaccgtctcccattgttttactggctactaacggagggagcgccactaatgcaggtacgatcacaggtaaagtgacggaacaacatagcgtatttaacaagtattcaacgggcacatcgaattcatttatttttaataacgatgtcagtagcataacagggttagtcgctcaatcgaatagcacaattatcaatactgacagcggcatcattgatttgtatggtcgtggtagtgtcggcatgcttgctatagcagattcaacagcagaaaatcagggtaaaattacactggattctatgtgggtagatgcaaatgacactaccgcaatgcgagatatagctagcaacagcgccattgacttcggtacaggtgtgggagttggtactgatagttatagtggtgcagggaaaaatgcaacagcaattaaccaattgggcggtgttataactatttataacgccggcgcaggtatggcggcctatggcgccagcaatacagttattaaccaggggacgattaacctcgaaaaaaatggtaattatgacgatagtctggcagcaaatactctggtagggatggctgtttatgagcatggtactgctatcaacgaccagacgggtgttatcaatatcaatgttggtactggtcaggcgttttataacgatggcacaggaacaattgttaactatggtacaatctgcactttcggcgtgtgccaatcggggaatgagtacaataatacagatgatttcacctcactgatctataccggtggcgatacgattacacgaagcggagaaactgtaacgctaaataaatctgctgctgtgactgataagctggctgggaatgttgttaatagcggaacgctttccggtgatcaaattacggtatcaagcggtcttctggaaaataccagcggtggcatcatcaataacttagtaaaacttgacaagggtgccgtcattaaaaatgccggggtgatgacgaataacgtcgatgttagcggtggaatcctcaataatgccggagaaatgactgcgcaaattaccatgaatgctggtgctgatagttcgttagtgaacaacaccggaaccatcaataaaatcgtgcagaacgcgggggtattcaataatagtggcagtgtaacagggcggatgatgtcggctggcggggtctttaataatcaaactgacggggcgattatgagaggtgctgcgctgacaggtactgcagtggcaaataacgaaggaacctggaacctcggaagtagtagtgagggtaacaacaccgggatgctggaagttaataataattcagctttcaataaccgcggcgagtttattcttgataacgacaagaatgctgtgcacatcaaccagtccggtacgctttataataccggtcacatgaacatcagtaattcttcccacaacggagccgttaatatgtggggcggaaatggtcgttttatcaatgacggaacgattgatgtttctgcgaagtcactggtagtcagcgctaataatgccggcgatcagaatgccttcttctggaaccaggataacggggtcatcaacttcgatcacgacagcgccagtgccgtgaaagtcacccacagcaactttattgcccagaatgacggcatcatgaacatcagcggcaccggtgctgtggctatggaaggtgataagaacgcgcagctggttaacaatggcaccatcaacctcggtaccgcaggcactactgacacgggtatgatcggtatgcaactcgatgccaacgccacggcggatgcggtaatcgaaaacaacggcaccatcaatatcttcgccaatgactcgtttgcatttagcgtactgggtacagtaggtcatgtggttaacaacggcacggtggtgattgccgatggggttacgggttctggactgatcaagcagggcgacagcatcaatgttgaaggtatgaacggtaacaacggtaatagcagcgaagtgcattatggcgactatacgttgccggatgtgccgaagcccaatacggttagtgtaacgtcgggaagtgatgaggctggtggcagcatgaacaacctcaacggctatgtcgtcggtaccaacgttaacggcagcgccgggaagctgaaggttaacaatgccagcatgaacggcgtggagattaacacgggctttaccgctggtacggcagacaccactgtgagttttgataacgtagtggaaggtagcaacctgaccgacgctgacgccatcacctcaacgtccgtggtatggactgccaaaggcagcaccgatgccagcggtaacgttgacgtcaccatgagcaaaaatgcctacaccgatgtggcaacagatgcctcggtgaatgacatcgcgaaagcactggatgcgggttacaccaacaacgaactgtttaccagcctgaacgtcggcacgactgctgaactgaacagtgctctgaaacaggtcagcggtagccaggcgaccacggtattccgcgaagcgcgcgtgttaagcaaccgctttagtatgctggcagatgccgcgccgaaagtgggtaacggtctggcgttcaacgttgtcgcgaaaggcgatccgcgtgccgagttaggtaataataccgaatacgacatgctggcattgcgtaaaactatcgacctgagcgaaagccagacgatgagtctggagtacggtatcgctcgtctcgatggtgatggtgcgcagaaagcgggtgataatggcgttacaggcggttatagccagttttttggcctgaaacatcagatgtcgttcgataacggcatgaactggaataacgccttgcgttacgacgttcacaaccttgacagcagccgctcgattgcatttggcaacacgaacaaaacggctgataccgacgtgaaacagcagtacctggagttccgcagcgaaggggcgaagactttcgaaccgagcgaaggactgaaggttacgccatatgcgggtgtaaaactgcgtcacacactggaaggtggctatcaggagcgcaatgccggagactttaacctgaatatgaacagtggcagcgaaacggcggtggacagcatcgtcgggctgaaactggactacgcaggtaaagacggctggagcgctagcgctacgctggaaggcgggccgaacctgagctacgcgaagagccagcgtacggcaagcctggcaggcgcaggcagtcagcactttaacgtcgatgacggtcagaagggcggcggcatcaatagcctgacaagcgtcggcgtgaagtacagcagcaaagaaagttcgctgaatctggatgcgtacaactggaaagaggatggcatcagcgataaaggcgtgatgctgaacttcaagaaaacgttctaatttttagcatgtgatccctaaaccgcaacgctgatacaggttgcggtttttttattgccggatgtggtacgtgacgcgttttgttttgtgtctttcaggacaatagagcaactcatccagtaatcttgtttacaccttcgcattatttatctcttttcgtttctatactgatttttcttaatccgttttattacagggcagggtgcgatgagcagcaatacatttactctcggtacaaaatccgttaaccgtcttggttatggcgcgatgcaactggcaggtcctggagtttttggccccccacgagatcgccacgtcgctataaccgtgctgcgtgaggcgctggcattgggcgtcaatcatattgataccagcgacttttatggtccgcacgtcaccaatcagattatccgcgaagcgctttatccttactctgacgacctgacaattgtcactaaaattggtgcgcggcgtggagaggacgcatcctggttgcccgcattttctccggcagagctgcaaaaagcggtgcacgataatctacgtaatctcgggctggacgtgctggatgtggttaacctgcgcgttatgatgggggatggtcatggcccagcggaaggatcgattgaggccagcctgaccgtgctggcagagatgcaacaacaaggcctggtaaaacatattggcctgagcaacgtcacaccgacgcaggttgcagaggcgcgcaagattgccgaaattgtctgtgtgcaaaacgaatacaacatcgcgcaccgtgctgatgatgcaatgattgatgctttggcccacgatggcattgcctacgtgccgttcttcccgctcgggggctttacaccgctgcaatcgtccacactttccgatgttgctgcgagcctgggtgcaacaccaatgcaggtggcgctggcgtggctgttacagcgttcaccgaatattttgctgatcccagggacgtcttcggttgcgcatttacgggagaatatggctgctgaaaaattgcatctttctgaggaagtgttgtctacgttggatggtatttcgcgagaataacgaatatacaaaagggaaagatgcatttccctttttttcttttttaatggcatggagtgcatatgttgaaggccaggaattgcggctggatacgtttactgcccctgtttatgctgagtctaccagtacaggcggaacttcgatgtgttgcaaatgcagttgatattgaatcatttttttctgcggctaccgctgaagataaacaacaagttgaacaagctatcaacagtagcgtgaatcttgtccccttcggtttatctgcatcgaactggaaagtgcatcgtggcgatttagtggtagaaggtaatatagagagtaatcaaaaattgattgttcttgggaatttgacagtcaaaggtaatatttccactttctctctttctaatccatgggttattctcggtaacgtgacggcaacgaatatagttgcggattcaccactgttaattaccggttcgataaatgcaagtggactggtatttatcgactcatattacgataatccgtctacgattaaggggagtattaatgcgcgtgggatatttatcaatgacataattgcacctgttgttgcgtcttcgacaaatagtgaattcatggtccgtgcgagtgacaaacatgacactgaaaatgtcaaaaaagcgctgatgataataaatcctgatgcatattattgggggctaattaatgatgaagatgctctgaaagaaatttttaagcgaagcaatattcgcatggcagggaatgtctgtaatcagatgaaaaaagaagcgctgtttcgccctaagccttctcctgagttagtgcaagaattgcaaatgctggatgaaggcaaagttgctgcatttgaaggacgagacattgcgacatttgatcttgccgtaatgcgaactctcccaaggcttaaaggaatttcagctaacctacgcaaacaacttattaatagcaatgatgaacaaacgattgaaagtatggcgagatatatgcctgacaatgagattctggagttgaccgatcagcaattgggttaccagcctgttgttctggggttgctcgaccgtgaaccgctctctgtcgaaataatgacgcgaatgagtcgtctacctgatggtgtcggtccgttgaatcttgcgctacgtgaaaatctccctctggatatcgtcatgactctggcgaaaagagattgggatatgatcattcaggagctttataaagatgcgtggttattgcctgaatccattattgatggctatatccgcagtgatgattcctctattcgtcaggtcggtgctggaggacaactcacctacaatcaggcaatgcagttggcgaacgattcatcaaacaatgttgtcacaagcttagcgttcaagctggcagagatgaaacaccatggtcaattgttgcggatgacgccacaagagagtgacaaagttgcaggctatttataccaaaaattcgagaatgacgatgatctaatacgtgtgttatttttagcattgccagataacttacagtttaattttgttaaaaggatggagaaaaaatccccggcctacttttgctgtcgggatatgcaggtaattcactctgacgctgctttacaacggttattgacacgtttcaacgatcctgaagggtggagtaatctggcgaaaaatcagtatctgagcacgtcgatgaaacaaaaaatttggcaacgtgctttatcgcatcggaaaaataatccgaaagcagattcagatgcatatgaaaccagcgctgatatgattttgtctgagctgattagccacggcgaagttgatgaccagatgctattaaatgccaccgccctgatacgttcggacgactgggactttttagagagtgcattaattagttgggataatttacccgctgttgttctcaaggaattacagcaaaacacgccacgcaatgatatttgggcgaagttttttctgaggcaggaaaacagttcccgtgcgcaggttgacgaagcgttacgtgtttattatgcactagaccccgatgcgttagcacaactggatgtactggcaaaacaaccggatcgtatatggtggagtacactggcgaaaagcaatctcacatttttcaagttcggcgcacttaacaaccgccacacaccgcctgcagtactggcggcagaaattgatcccgagtggtggattgtggcgatgaataatccccgttttccagttgatgtattaaaggcgaggctgaaacgtgatcctttgctggcgttagagcttgttaaccctgaactggatttagtccgccagctggcgcttaacggtaagacgcgcgcaatacgggaacaagcgatgagaaaacttgatgagttgtattgatccacaacgtaatgttttttaactatctgattaattggggataatcattcctgacagtgagtccccaataccttgatatattctgaatttttaatgaaacggcgtgttgcgatatctccgtcaggggaattgatgcaccatagcgcaaaccgaattatcaaggattgataatgacgctctaccagataaaaccgctctttcagtcgctgttaaggccgacgatgttttggctttataagcaccacgttacagcgaatcacatcactcttgctgcactggcgctttctcttcttaccggattgctgttgatgttggcggcacaacccatcctctttttgctattgcccatcgtgctttttatccgtatggcgctcaatgcgctggatggcatgttggcgcgtgagtgcaaccagcaaacacgtctgggggcgattttgaatgagactggcgatgttatttccgatattgcgctctatttaccatttttatttttaccggaaagtaacgcatcactcgtgatactcatgttattttgcaccatattgaccgagttttgcggtttactcgcgcagacgattaacggtgttcgcagttatgccggtccatttggcaaaagcgatcgcgcgttaatatttggtctgtggggtctggccgttgccatttatccacagtggatgcagtggaataatcttttatggagcattgcttcaattctgcttctctggactgcgattaatcgttgtcggagtgtgcttcttatgagcgctgaaatataatgctggaaaaatctctggcaacacttttcgcgttgttaattttagcaacgctgataaaccgttttctgctatggcggttaccggagagaaaagggggtgaggttacattacgtattcgtacctggtggggcatcgtcatttgtttttcaatggtgatttcaggtccacgctggatgacgttgacgttttttgcgctgataagttttctggcattgaaagaatattgtacgcttatatctgtacattttccgcgttggttatattggggtattcctcttaactatttgcttatcggttttaattgctttgagctgtttctgttatttatacctttggctgggtttctgatattagccaccgggcaagttttagtgggtgacccctctggttttctgcataccgtgagcgccattttttggggctggataatgaccgttttcgccttgagtcatgccgcctggttattaatgttgccaaccacaaatatccagggcggggcgttactggtgttatttcttttggcattaaccgagtcaaacgatattgcacagtatttatggggaaaatcctgcggcagaagaaaagtggtccctaaagtcagcccgggaaaaacattggaaggtctgatgggcggcgtcatcaccatcatgattgcgtcactgattatcggaccgttactgacaccgctaaatacattacaggcattattagcgggtttgttaattggtattagtggtttttgcggcgatgtcgtgatgtcagccatcaaacgagatattggtgttaaagatagcggaaaactattgccaggacatggcggactccttgacaggattgactcattaattttcaccgctccggtatttttttattttatacgctactgctgttactgaaggaaaatagagaaaatggaaaattcacgcatccctggggaacatttttttaccaccagtgataatacagcgttgttttatcggcactggcccgctttacagcccggggcgaaaaaggtcatcgtcttatttcatcgcgggcatgaacattctggtcgtctacaacatctcgttgatgaactggcgatgccagatactgctttttatgcctgggatgcccgagggcatggaaaaagttcggggccgcgtggttatagcccatctcttgcgcgttcagtgcgggatgtcgatgaatttgtccgttttgctgccagcgacagccaggttggactggaagaggtggtagtgatcgcgcaaagcgtcggcgcagtgctggttgccacatggattcatgattatgcacctgcaattcgcgggctggtgctggcttctccggcctttaaggttaaattgtatgtgccgctggcacgtcctgcgctggcgttatggcatcgtctgcgtggtctgttttttattaattcctatgtgaaaggacgctatttgacccacgatcggcaacggggggcgagtttcaataatgatccgctgatcacacgggcgattgccgttaatatcttgctcgatctctacaaaacgtctgaacgtattattagagatgcggcggcgattacgctccccacgcaacttctgatatcaggcgatgactatgtggtgcatcgccaaccgcagattgatttttatcagagattacgtagccctctgaaagagctgcatctgctgccaggcttttatcacgacacgttgggtgaagagaacagggcgctggcatttgaaaaaatgcaaagctttattagtcgtttatatgctaacaaatcgcaaaaatttgattatcagcatgaagactgcacaggaccatcagcggatcgatggcggctactttctggtggacccgtgccattatcgccggttgatttagcgtatcgctttatgcgaaaggcgatgaaattgttcgggacgcactcttcgggcctgcatctcggaatgagcaccggctttgattcaggcagttcgctggattatgtctatcaaaatcaaccgcaaggtagtaacgcattcgggcgtttagtcgacaaaatctacctgaacagtgttggctggcgcggtattcgccagcgcaaaacccatttacaaatactgattaaacaagccgttgccgatctccacgccaaaggtttagccgtccgcgtggttgacattgccgcagggcatgggcgctatgtactggatgcgctggcaaacgagcctgccgtaagcgatattttgttacgtgattacagcgagttaaatgttgcacaggggcaagagatgattgctcaacggggaatgtctgggcgggtgcgttttgaacagggcgatgcgtttaacccggaggaactcagcgcgttaactccgcggcctacgctggcgattgtctctggcctgtatgagctttttcccgaaaatgagcaggtaaaaaactcactcgcaggtcttgccaatgccatcgaaccgggcggcattctcatctacaccgggcagccgtggcaccctcaactggagatgattgccggggtgttaaccagtcataaagatggtaaaccgtgggtaatgcgcgtgcgttcgcaaggggagatggattcactcgtgcgtgatgccggatttgataaatgcacacaacggattgatgagtggggtatttttacggtttcgatggcggtgcgtcgtgataactgaacgtcggaacgtattgctacaaggcgctggctggttattgttgctggccccgtttttcttcttcacctatggatctcttaatcagttcaccgcggttcaggaccttaacagccatgatatccccagtcaggtattcggttgggaaacggcgatcccttttcttccctggactattgttccttactggagtctggatcttttatatggattttcgctgttcgtttgtagcacgacattcgaacagcgccgacttgtccaccggcttattctggcaacggtaatggcctgctgcggttttttgctctatccgctgaagtttagttttatccgtcctgaagtgagtggggtgacgggatggctattttcgcaacttgaactgtttgatctgccttataaccagtctccttcgctgcatattattctctgctggctactttggcgtcactttcgtcagcatctggctgagaggtggcgtaaagtctgcggcggatggtttttactcatcgccatttcgacgctgacgacctggcagcatcattttattgatgtcatcacagggctggcggtaggtatgttgattgactggatggtgcccgtcgaccgtcgttggaattatcagaaacctgatcaacgtcgaatcaaaatagcactgccctatgtcgtaggcgcgggctcgtgcattgtattgatggagctaatgatgatgattcagttatggtggtcagtctggttatgttggccagtattatcgctactcataattggccgtgggtacggtgggcttggcgcgataacaacagggaaagatagtcaggggaaactaccgcccgccgtttactggctgacattgccctgccgcatcgggatgtggctgtctatgcgttggttttgtcgtcgcctggagccggtgagcaaaatgactgctggtgtttatttaggggcgtttccacgacatattccggcacagaatgcggttctggacgtcacctttgaattccctcgcggacgagccacaaaagatcgactctatttttgtgtaccgatgctggatctggtggttccggaagagggggagctccgacaggccgtggcgatgctggaaacattacgcgaagagcaaggcagcgttctggtccattgtgcattgggattatcgcgcagtgcgctggtggtggcggcatggttgttatgttacggacactgtaaaaccgttaatgaagcgattagctatattcgagccagacgcccgcagattgtgctgacagacgagcacaaagcgatgctgagattatgggaaaacaggtaagtggattgagatgtggactgaatatctacagtccacatcaagaccgtgtccggttatgcagaaacaatgctgtcgatggctgcttttgcgtcagactgtgctttcgctgccatttccggaccgtatgcgatcccttcggcgaagacaaatttcacatcggtaatgccgataaagccgaggaacgtggacagatacggcgtcaccaggtccgttggtccatctttgtggatcccgccgcggctggtaataacgatggcttttttacccgttaccagaccttccggaccgttctcggtatagcggaaagtaacgcctgcgcgggcaaccaggtcaaaatagtttttcaactgagtcgagatgttgaagttatacatcggtgccgcaataacgataacgtcgtgggctttcagctcggcaatcaactcatcggaaagtgccagagcttcctgctgacgcggagtcagcggcgcatcgctcggacgcagagcgccaaccagttcgccatccagtaccggaatcggatttgcagccaggtcgcgaacggtgatttcatcagcggagtgcttttcgcgccattgttcaacaaaataatcggacaactgattagactgagagtaccctgccaggatgctggatttaagaactaataccttgctcatggtgtttccttatagatgtttgaatgggcgatgccccgttgcttgttgacactttattcacaatcctgccacagagatagcgcaataaatcgaagcctatgttcgaatttattgaacaacgcatagaaagccgcgatgtggtactctatatctatcatttaaaagaaaattaatcaggcagactactgcccactaacgttatgacagaacaacaaaaattgacctttacggccttgcagcagcggctggattcgctgatgctgcgtgacagactgcgtttttctcgccgtctgcacggcgtgaagaaggttaaaaatcctgatgcacaacaggccattttccaggagatggcgaaagagattgaccaggcggcagggaaagtcctgctgcgtgaagcggcacgaccggaaattacttatcctgacaatttaccggttagtcagaaaaaacaggacattctcgaagcgattcgtgatcaccaggtggtgatcgtcgccggggaaacgggttctggtaaaacgactcagttaccgaaaatctgtatggagctggggcgcgggattaaaggactgatcggccatacccagccgcgtcgtctggcggcaagaacagtggcgaaccgtattgcggaagagctgaaaacggagccgggcggttgcatcggttacaaagtgcgtttcagcgatcacgtaagtgataacacgatggtcaagctgatgaccgacggtatcctgctggcggagatccagcaagaccgcctgctgatgcagtacgacactatcattattgacgaagcgcacgaacgcagcctgaatatcgattttttgctcggctatttgaaagagttgctgccgcggcgtcctgacctaaaaatcattatcacttccgcgactatcgacccggaacgcttttcgcgccactttaataatgcgccgattattgaagtctccggtcggacctatccggtggaagtgcgctatcgcccgattgttgaagaagccgatgacaccgagcgcgatcagttgcaggcgatttttgacgccgtagacgaactgagtcaggaaagccatggcgacattctgatctttatgagcggcgagcgggaaatccgcgataccgccgatgcgctgaacaagctgaacttacgccataccgaaatcttgccgctttatgcgcggctttcgaacagcgaacaaaatagggtattccagtcgcacagcggacggcgcattgtgctggcgaccaacgtcgcggaaacgtcgctgaccgtaccggggattaaatacgttatcgaccccggtacagcgcgtatcagccgctacagctatcgcaccaaagtgcagcgtttgccgattgagccgatttcccaggcgtctgccaatcagcgtaaaggccgctgtggtcgtgtgtccgaagggatctgtattcgtctctattccgaagacgatttcctctcgcgcccggagtttaccgatccggagattctgcgtaccaacctggcctcggttattttgcagatgaccgcgctggggctgggcgatatcgctgcgttcccgtttgtcgaagcaccggataaacgcaatatccaggatggcgtgcgtctgctcgaagagctgggcgcgatcaccactgatgaacaggccagcgcctataaactgacgccgctcggtcgccagctctcgcagttgcctgtcgacccacgtctggcgcgtatggtgctggaagcgcaaaaacatggctgcgtgcgtgaggcgatgattatcacgtccgcgctctccattcaggatccgcgcgaacgtccgatggacaaacagcaggcatcggacgaaaaacatcgtcgcttccacgacaaagagtctgactttctcgcgtttgtgaatctgtggaattatcttggcgagcagcaaaaggcgctttcttccaacgccttccgtcgcctgtgtcgtaccgattatctcaactatctgcgcgtgcgcgaatggcaggatatctacacccagttgcgtcaggtggtgaaagaacttggcattccggttaacagcgaaccggcggagtatcgcgaaattcacattgcgttgctgaccggtttactttcccatatcggcatgaaagatgccgataaacaagaatataccggcgcacgtaacgcgcgtttctccatcttccccggttctggtttattcaaaaaaccgcctaaatgggtaatggtggcggaactggtagaaaccagccgcctgtgggggcgcattgctgcgcgtatcgacccggaatgggtggagccagttgctcagcatttgattaaacgcacctacagcgaaccgcactgggaacgggcgcagggcgcggtgatggcaacggaaaaagtcactgtttatggtttgccgattgttgccgcgcgcaaggtcaactacagccagatcgatccggcgttatgtcgtgaactctttattcgccacgcgctggtggaaggtgactggcagacgcgtcacgcattcttccgtgaaaacctgaaactacgggcggaagtagaagagctggaacacaaatcacgtcgccgcgatattctggttgatgacgaaacgttgtttgagttctacgaccagcgcatcagccacgatgtaatctccgctcgccacttcgacagctggtggaaaaaagtcagccgcgaaacgcctgatttgctcaactttgaaaaaagcatgttgatcaaagagggcgcagaaaaaatcagcaagctggattacccgaacttctggcatcagggcaatctcaagctgcgtttgagctatcagtttgagcccggcgcggatgctgacggtgtgaccgtacatattccgctgccgttacttaaccaggttgaggaaagcgggtttgaatggcagatccccggtctgcgccgcgaactggtgattgctctgattaaatcgttgccgaaaccggtacgccgtaattttgtacccgcgccaaactatgccgaagcgtttttaggccgcgtcaaaccgctggagttaccgttgctcgacagccttgagcgcgagttacggcggatgaccggcgttaccgttgaccgcgaagactggcactgggatcaggtgcccgatcacctgaaaattaccttccgcgtggtggatgacaaaaacaagaagctaaaagaagggcgctcgctacaagatctgaaagatgcgctgaaaggcaaagtgcaggaaacgctatctgcggtggcggatgacggtatcgagcagagcggcttacatatctggagttttggtcagctgccggaaagctacgaacagaagcgtggcaactacaaagtgaaggcgtggccggcgctggtggatgagcgcgacagtgtggcgatcaaactgtttgataacccgctggagcaaaagcaggcaatgtggaacggtcttcgccgtctactgctgctgaatattccatcgccaatcaaatatttacatgaaaagttaccgaacaaagccaagctgggactgtactttaacccgtatggcaaagtgctggagctgatcgacgactgtatctcctgcggtgtggataaattgatcgacgccaatggtggcccggtctggacggaagaaggctttgctgcgctgcatgaaaaagtgcgtgccgaactgaacgacacggtggtggatattgcgaagcaggtcgagcaaatccttacggcagtgttcaatatcaacaaacgtctgaaagggcgggtggatatgaccatggcgctggggctttctgacattaaagcgcagatgggcgggttggtatatcgcggttttgtcactggtaacggcttcaaacggctgggcgacacgctgcgatatttgcaggcgattgaaaaacggctggaaaaactggcggttgatccacatcgcgaccgtgcgcagatgctgaaagtcgaaaacgtccagcaggcgtggcagcaatggatcaacaaactgccgcccgcacgtcgtgaggatgaagacgtgaaagagatccgttggatgatagaagagttgcgcgttagttacttcgctcaacaacttggtacgccttatccgatttcagataagcgtattttgcaggcgatggagcagattagcggttaaccctgctatttgcctgataaagaaaaaacccggtaagcatttagcgccgggttttttattaattctaaaacggtaagggtaaaaattcaggaattcagaaaaatacaattctctgctgcaagatgaataatgtttatctacagcatttccttaaaagatatgtcaggcttgcggagtggcggttaaggacatacgatttcctcctttcagagtgctccgcttctcactattatctcacgcagtattcttaagggaacgataaggaggaaccatgaacattaccccgtttccgacgctttcgccggcaactatagatgccataaatgttatcggacagtggctggcgcaggatgatttctccggtgaggtgccgtatcaggccgattgcgtgatccttgcaggcaatgcggttatgccgactatcgatgcggcatgtaagattgcccgcgatcagcaaattcctttactgattagtggtggtatcggtcactcgacaacttttttgtatagcgccatcgcacagcatccgcactacaacactatccgcaccactggcagagcagaagcgaccatcctggcggatatcgctcatcagttctggcacattccgcatgaaaaaatctggattgaagaccagtcaacaaactgcggtgaaaacgcacgctttagcatcgcgctattgaatcaggccgtagaacgagttcatacggctatcgttgttcaggaccccaccatgcagcggcgcacgatggcgacgttccgccgtatgactggggacaatcccgatgcaccacgctggttaagttatcccggattcgttcctcagttaggaaataacgcagacagtgtaatctttattaatcagttacaaggattatggccagttgagcgttatctctcactactcactggcgagctgccgcgtttacgcgatgatagcgatggctacggtccccgcgggcgagattttatcgttcacgttgattttccggcagaagtcatccatgcatggcaaacgctgaaacatgatgcggtgctcatcgaggcgatggaaagtcgctcgttacgttaaaaattgcccgtttgtgaaccacttgtttgcaaacgggcatgactcctgacttttatttctgccttttattccttttacacttgtttttatgaagcccttcacagaattgtcctttcacgattccgtctctctgatgattgatgttaattaacaatgtattcaccgaaaacaaacatataaatcacaggagtcgcccatgtcagtacccgttcaacatcctatgtatatcgatggacagtttgttacctggcgtggagacgcatggattgatgtggtaaaccctgctacagaggctgtcatttcccgcatacccgatggtcaggccgaggatgcccgtaaggcaatcgatgcagcagaacgtgcacaaccagaatgggaagcgttgcctgctattgaacgcgccagttggttgcgcaaaatctccgccgggatccgcgaacgcgccagtgaaatcagtgcgctgattgttgaagaagggggcaagatccagcagctggctgaagtcgaagtggcttttactgccgactatatcgattacatggcggagtgggcacggcgttacgagggcgagattattcaaagcgatcgtccaggagaaaatattcttttgtttaaacgtgcgcttggtgtgactaccggcattctgccgtggaacttcccgttcttcctcattgcccgcaaaatggctcccgctcttttgaccggtaataccatcgtcattaaacctagtgaatttacgccaaacaatgcgattgcattcgccaaaatcgtcgatgaaataggccttccgcgcggcgtgtttaaccttgtactggggcgtggtgaaaccgttgggcaagaactggcgggtaacccaaaggtcgcaatggtcagtatgacaggcagcgtctctgcaggtgagaagatcatggcgactgcggcgaaaaacatcaccaaagtgtgtctggaattggggggtaaagcaccagctatcgtaatggacgatgccgatcttgaactggcagtcaaagccatcgttgattcacgcgtcattaatagtgggcaagtgtgtaactgtgcagaacgtgtttatgtacagaaaggcatttatgatcagttcgtcaatcggctgggtgaagcgatgcaggcggttcaatttggtaaccccgctgaacgcaacgacattgcgatggggccgttgattaacgccgcggcgctggaaagggtcgagcaaaaagtggcgcgcgcagtagaagaaggggcgagagtggcgttcggtggcaaagcggtagaggggaaaggatattattatccgccgacattgctgctggatgttcgccaggaaatgtcgattatgcatgaggaaacctttggcccggtgctgccagttgtcgcatttgacacgctggaagatgctatctcaatggctaatgacagtgattacggcctgacctcatcaatctatacccaaaatctgaacgtcgcgatgaaagccattaaagggctgaagtttggtgaaacttacatcaaccgtgaaaacttcgaagctatgcaaggcttccacgccggatggcgtaaatccggtattggcggcgcagatggtaaacatggcttgcatgaatatctgcagacccaggtggtttatttacagtcttaatgagtgaaagaggcggaggttttttcctccgcctgtgcgcgtcagagtttagcgaatttttcgagggtgcgaataagctgtgtgacgaagccatattcgttatcgtaccaggcgaccgttttcaccagttgtaaatcgcccacggcggtaatttccgtttgcgtggcatcaaacaccgaaccgaaatggctgccaatgatatcggaagagactatttcttcatcggtataaccaaatgactcgttattggtggttgcttgtttaagtgcgttattcacctcttcggcagtcacttttttccgagaatcgataccagttcagtgaccgaacctgttttcaccggcacgcgttgcgcatgacctttcagtttgccgctcagttccgggatcaccagaccaatggcttttgccgcccccgtagtgtggggaatgatattttctgccgctgcgcgtgaagcacgtaaatctttaccacgcgggccatccaccagtgactgggtgccagtataggcatgaatggtcgtcatcgtgccgacttctatcccgaaactgtcatgcaaggctttggccatcggcgcaagacagttagtggtgcatgacgccacggaaacaatggtgtcgttgccatccagagtgtcgtcattgacgttataaacgatagttttcatttcaccggcaggggcggaaatcaacaccttcttcgcaccagcatcaagatgcgcctgcgatttctcggcggaggtataaaagccagtacattcgacaatgatttctgcacctttcgctttccacggaatatttttagcctctttttcggcgtaaaccgcgatacttttcccatcaacgataagtgaatcttccgtaaaatcaacgctccaggggaatggtccgtagtttgaatcatgtttcagcaggtaggcgagaatttatggggaagtgagatcattaatagcgacaacgtctatgttgcttttgacttcaagtaatcgacccaacaccagtcgaccgatacgaccaaaaccgttaataccaactttactcatggttttctcctgtcaggaacgttcggatgaaaattgatcctttccaagcttagaccaggatggcgggatgggcaatctccattctcacagtgaaacgtaacgtactgaaaacgggtgaacaatatttaatgaaattttgagaaaagcccgttatgttaacggaaaattatgttaaagcaggaaatgttatggaaaataaatattcaaggttacaaatcagcattcactggctggtctttttactggttatcgcagcgtattgcgcaatggagtttcgtggtttcttcccacgtagcgatcggccactcatcaacatgattcatgtttcctgtggcatctcaattctcgtgctgatggtcgttcgtcttttgttaaggctgaaatacccaaccccgccgattatacctaagccaaaaccgatgatgacgggactggcgcatttgggacatttggtgatttatctcctgtttattgcgctgccagtgattggtttggtgatgatgtataaccggggcaacccgtggtttgcgtttggtttgacgatgccttacgcttcagaggccaatttcgaacgggtagatagcttaaagtcgtggcatgaaacgctggcgaatctgggatattttgtcatcgggttgcacgctgcggctgcactggcacaccactatttctggaaggacaacacacttctacgcatgatgccgcgtaaacgttcctgaaggatatttaaagaaaacgcctgtactaaaaccgacccgtggtacaggcgaagaatacgggtctacatcggaagcgcctattatatttatttgtatgataaataaaaccataatccttgcccatacgtccatctggcttatttttaatcaattcacccgatctttgatctcatcaacggtatcaaaataaaccagcgtataacgttcaaatcgaacataagattcgataaaccatggaggttatatgaaaaaactggcacttattttgtttatgggaacgcttgtttccttttatgccgatgccgggcgcaaaccctgttctggttcgaaaggggggatctcacactgtacggcaggcggcaaatttgtctgtaatgatggttctattagtgcatcgaaaaaaacatgcactaactgaagtgtaaaaggggtgccatgagaaaatgaatctgctagtcaaatgcgcggggaaaatccccgcgcttgcccttacctggacgtgcaggccatgagcgcagcaacctccttatcaccgtcccggaaccgcagttcgtagagcgtttgtcgggtcaggagtgtgaatgtcagaatcgtaatgcagataatgagcagacacaccaccagagggttgtgcttcatagcctttctccttgccggatggcgggtaagaggctaagatctgaattgctaggttcattcgttggcctcggttgatagaaatatcggtcggggccttcgtctttctgattcccggttagcctgaaaacagaaagtctcaggcacccgcaggcatcctatgaggtttccttagggacgaaaataatcacttcacgaaattgcgtgctgttttccagaatttttcgtcattcgggttagccagtttagccattcgttactctcttcattccaatagcattaattttctatgcaataattgttgtaaaaatgtgacgcaaagaggtttttggtcataagtaattaccgtcaagtgccgatgactttctatcaggagtaaacctggacgagagacaacggtaatgaatacaactccctcacagcgattaggttttttgcatcacatcaggttggttccgttatttgcctgcattctaggcggtatcttagttctattcgcattaagttcagccctggctggctatttcctctggcaggccgatcgcgatcagcgtgatgttactgcggagattgagattcggaccgggttagcgaacagttcagattttttgcgttcagcccggatcaatatgattcaggccggggctgcgagtcgtattgcggaaatggaagcaatgaagcgaaatattgcgcaagccgaatcggagattaaacagtcgcagcaaggttatcgtgcttatcagaatcgaccggtgaaaacacctgctgatgaagccctcgacactgaattaaatcaacgctttcaggcttatatcacgggtatgcaacctatgttgaaatatgccaaaaatggcatgtttgaagcgattatcaatcatgaaagtgagcagatccgaccgctggataatgcttataccgatattttgaacaaagccgttaagatacgtagcaccagagccaaccaactggcggaactggcccatcagcgcacccgcctgggtgggatgttcatgattggcgcgtttgtgcttgccctggtcatgacgctgataacatttatggtgctacgtcggatcgtcattcgtccactgcaacatgccgcacaacggattgaaaaaatcgccagtggcgatctgacgatgaatgatgaaccggcgggtcgtaatgaaatcggtcgcttaagtcgtcatttacagcaaatgcagcattcactggggatgacagtagggactgttcgacagggcgcggaagagatttatcgtggcaccagcgaaatttcagctggcaatgcggacctgtcatctcgcaccgaagaacaagcggcggctatcgaacaaactgccgccagcatggagcaactcactgcgacggtgaaacagaatgcggataacgcgcatcatgccagcaaactggcgcaagaggcttctattaaagccagcgatggcgggcagacggtttccggtgtagtaaaaacgatgggcgctatctccacgagttcgaagaaaatttctgagatcaccgccgtcatcaacagtattgctttccagacgaatattctggcactgaatgctgccgttgaagccgcgcgagcgggtgagcaagggcgtggatttgccgttgtcgccagcgaagtacggacactcgcaagtcgcagcgctcaggcggcgaaagagattgaaggcttgatcagtgaatcagtcaggttaattgacctggggtcggatgaggtggcaacggccgggaaaaccatgagcactattgttgatgccgtcgcgagtgtcacacatatcatgcaggaaatcgccgccgcctcggatgaacaaagtagaggcataacgcaggttagccaggcgatttctgaaatggataaggtgacgcaacagaatgcttctctggtagaagaggcctcagcggcggcggtgtcccttgaagaacaggcggcacgattaactgaggcggtggatgtattccgtctgcacaaacattctgtgtcggcagaacctcgcggagcgggtgaaccagttagtttcgctacggtgtgaaaatgttcaaggagggatcgacagatcccttcacctttcagaacggcattgattttcgaatagcgttaatcatcaactggcaaccagaagagaacgtcgcatctacgcgggtcagtattccaatcggttcgcctgcaccatgtcccggaacaggcagggccaccagcgtggcatgacgcaggtcgtcttttacagcgccagaagggacaaaccacacgtaatcgtattcaaccgtaagttgacgagatagcgaagcagacagcgtttcgatacaacccgaaggaattttacagccctggctctgcactaatgcatctgaatgctggcgtggcgcagtgccttctggtgatacaacgaccggccattccagcacccggcttagcgttacgttctcctgaagtagcgggtgattagggcggacaaccagcttcaacgattcaagaaacagcagttcgtaattaagcccggtcatcagttcaggatctgacatccgaccaatgccgatatcgatttccccggtttttaaacccgccagaatcatagggttactcattgtcgcaacttgcaaggtcgtctctttttgttgctgatgaaactgacctataaccgaaggtaatatccccagtgccgcagtaggtagtgcaccaaccctgacgacatcattattaagaccttctttacgatgaagcgaccgtccggcagtgttgatggcgtcaagaactctgactgcatgcgttaaaaattgttcgccgggtaaggtaagttgcgccccctgacgaccacgctcaaacaagcgagcgccagtcagctgctccagttcattcaatgtcttagagagcgcaggttgactcaaattaagggtttcagccgcgcgccccaaagttccttgttgtgcgacagctacgaatgtatgaaggtggcgcaaacggatgcgctgactaaacagactatttttttccataagcgatgttaaaaacgaagcggtgtcgctgacaagtgaagttgtttgattatgataacttgattgcaaaatattattaacaattaaagcaattatgttacagcaaaatggataatattgatgttttcgcggcgagatcacagtttgtaaattcttcccgcaagagtgaatgcggttacctacactccagattactgaccactggaggcagacactatggcgaacagcatcacggcggatgagattcgggaacagttttcgcaggcaatgtcagccatgtaccagcaagaagttccgcaatatggcacgctgctggaactggtagctgatgtgaatctggctgtgctggaaaacaatcctcaactgcacgaaaaaatggtaaatgcagacgagctggcgcgactgaatgttgaacgtcatggggcgattcgcgttgggactgcacaagagcttgctactcttcggcggatgtttgccattatggggatgtacccggtgagctattacgatctctcgcaggcaggggtgccggtacattcgacagcatttcggcccattgatgatgcttctctggcgcgtaatcccttccgcgtttttacctccttactccgccttgagcttatcgagaacgaaattttgcgccagaaagcggcggagattctgcgtcagcgcgatatcttcaccccacgttgtcgacaactgttagaggaatatgagcagcagggcggttttaacgaaacacaggcacaggagtttgtgcaggaagccctggaaacgtttcgctggcaccagtcagcaacggtagatgaagaaacctatcgcgcattgcacaacgaacatcggttgattgctgatgtggtctgttttcctggatgccatatcaaccacctgacgccacgtacgctggatattgaccgggtgcagtcgatgatgcctgaatgcggaattgaacccaaaattctcatcgaggggccgccgcgccgcgaggtaccgattttactacgccagaccagctttaaagcactggaagagacggtgttgtttgcggggcagaaacagggcacgcataccgcgcgctttggtgaaattgagcagcgtggcgtggcattaacgccgaaagggcgacaactgtatgatgatcttctgcgtaacgctggaaccgggcaggataatctcactcaccaaatgcatttacaggaaaccttccgcacttttcctgacagtgagtttttaatgcgtcagcaagggttggcatggttccggtaccgtctgacgccttcgggtgaggcgcatcgtcaggcgattcatcctggagacgatccacagcccttaattgaacgtggttgggtagtggcgcaacccatcacctatgaagatttcttgcccgttagcgcggcggggatcttccagtcaaatctgggtaatgaaacgcagacacgcagtcacggtaatgccagtcgcgaagcatttgagcaggcgttgggttgtccggttttggatgagttccagctttaccaggaagcggaagaacgcagtaaacgtcgctgtggtttgctttaaaatctgaccatccgcctttgcaaaaatttgcctgattttacaaacgaatcaggctcatcccatcgacataaaaaaaatgccgatttatgcatattctctcagttcaacaattggattattaataaatattgtctagagtgagcggtcataaataagcactttcttgccgctgaaaacgaccagcgcgggaccattcacaacaccagaaggactcactttcaggtatggatcgtagacgatttattaaaggttcaatggctatggccgccgtgtgcggtaccagcggcattgcttctcttttttctcaggcggcattcgcggcagattctgatattgccgacgggcaaacccagcgttttgacttctccattctacagtcaatggcgcacgacttagcgcaaacagcgtggcgtggtgcgcctcgtccgttacctgacacgctggcgacaatgacgccgcaggcttataacagtattcaatacgacgccgaaaaatcgctctggcataacgttgagaaccgtcaactggacgctcagttcttccatatgggaatgggattccgtcgccgcgttcgtatgttttctgtagatccagcaacacatctggcgcgtgaaattcactttcgcccggagttgttcaaatacaacgatgcaggtgttgatacaaaacaattagaagggcaaagcgatctcggctttgccggttttcgcgtgtttaaagcccccgaactggcgcgccgtgatgtagtatcatttctcggcgcgagttatttccgcgccgttgatgatacatatcaatacggtttgtcggcccgcggcctggcgatcgacacttacaccgacagtaaagaagagttccccgactttaccgccttctggtttgatacggtaaaaccgggggcaactacctttaccgtttatgcgttgctcgatagcgccagcattactggtgcctataagttcactatccattgtgagaaaagtcaggtgattatggatgtggaaaatcacctgtatgcgcgcaaagacattaaacagctgggcattgcgccgatgaccagtatgttcagctgcggtactaatgaacgtcggatgtgcgatacaattcatccgcaaattcatgactctgatcgtctgtccatgtggcggggcaacggcgagtggatttgccgtccgctgaataatccgcaaaaattgcagttcaatgcttacaccgacaacaacccgaaagggtttggtttattgcaactggatcgtgacttctcccattatcaggacattatgggctggtataacaaacgcccaagtctgtgggtggaaccgcgtaacaagtggggtaagggcaccatcggcctgatggaaatcccaacaacgggcgaaacgctggataacattgtctgcttctggcagccagaaaaagctgtaaaagcaggtgatgagtttgcattccagtatcgtctgtactggagtgcgcaaccgcctgttcattgcccattagcgcgcgttatggcgacgcgtaccggcatgggcggtttctcggaaggttgggcgccaggtgaacactatcccgaaaaatgggcgcgtcgttttgccgtcgatttcgttggtggtgatctgaaagctgccgcgccaaaaggcattgagccggtgattacgctttccagtggggaagcgaagcaaatcgaaattctctatattgaacccatcgatggttatcgtattcagtttgactggtatccgacttcggactccactgatccggtcgatatgcggatgtatctacgttgtcagggggacgctatcagtgaaacatggctgtatcagtatttcccgccagcgccggataaacgtcagtatgttgacgaccgcgtgatgagttaatcgttttttcttcggcaccttcttcgggaggtgccgtctggttaaacacgatcccgctcgcatttttccctaagttaaatgagtaatctgatggtgtgtatttcagatacaccttgtcagccactaacagggagtgcgtatgtttccagaataccgagatttaatatcccgtctgaaaaacgaaaatcctcgctttatgtccttgttcgataaacacaataaacttgatcatgaaattgccagaaaggaaggttccgacggtcgagggtacaatgcggaagtggtccgcatgaaaaaacaaaagctacagttaaaagatgagatgctcaaaatcctgcagcaggagagcgtcaaagaggtgtaaactttcctaagccgccagccaggcggcttttttaacaactgcatggattgactggagataagatgactgaaacgataaaagtaagcgaatcacttgaattacatgctgttgcagaaaatcacgtcaaacctctttatcagttaatctgtaaaaataaaacctggttacagcagtcgctaaactggccgcagtttgttcaaagtgaagaggacacgcgaaaaacggtgcagggtaatgtgatgttgcatcaacgcggctatgccaaaatgttcatgattttcaaagaagatgaacttatcggcgttatctcgtttaatcgtattgaaccactgaataaaaccgctgaaataggctactggctggacgaatctcatcaggggcaggggatcatttctcaggcgctgcaggcattgattcatcattacgcccagtctggtgaacttagacgcttcgtgatcaaatgtcgggtggacaatccgcaaagcaaccaggtcgctttgcgcaatggttttatccttgaaggttgcctgaaacaggctgagttcctgaatgatgcctatgatgatgtgaacttatacgcgcgtattatcgattcacaataaccctgccagcggcgttcgcgtaatgcgctcctcgccgttaatgacttttggaccacggacatgaaccgtgtcgccatcaaaggcttcaacgacggcgtggtcggttaactccacatggttttcaattatcaccgcacctgtaatacggctctcaccttgtatgacaacgtgctcgtcgagcagaatcggtccgccacgtaccacggcatttccgccaaccaagacatgatgttttaacacacaattaccttccacaatggcatattccgccacctgcgaactgtaatgaatcgtcggaatggcatcttcttctatgccagctttcacctgcgcgtgaccgtagactttagcgcaatcgcatagccagacattgttctcttcattaccttcaatactggcaaaatcaaaaacttcggcgcgatgttcaataaaagcataccggacgacggcatcgccataaatttgtgcctggtggacaatacgcgaggcgctaacccttgcgcgatcataaatttggagcaggagttgatggtcgggcgttaagccttgtgcggcgacgatcatagaatgttgatcaattaaggcgtgaccaaatattctacattgcccgtaaactaatgagtcatgaatggtgacgctgtcacttatatatgcaccctggctgatttcactattatcgatccagacgttatccgttgcgtaaacctctccccacagcacgctggtgccggtgatacgcgtattaccggaaatcaccgctccgccgaacgcaatagcattctggtcgtaaatccagcaatttccttcttgtgctaacaccgtttcgcgatcgatccagccgccagcggttcctgctatcacatcgttaaaatcgctaatggcgataatctgccgtaataacacattttttttagtgccatcttcctgataactaaaggctcgctgttcttcacttagacgatatttgcgcatagcgttttcccacaggtgacttactataaccgtagcaaattctgcggctctggctatgctcgagaaaattccataaaatgcatttcaaatatactttataaattaaacaaaatgagtaagaagatgcagagcgataaagtgctcaatttgccggcaggctactttggtattgtgttggggacgatagggatgggatttgcctggcgctatgccagccaggtttggcaggtcagccactggttaggggatgggctggtgattctggcgatgatcatctggggattattgactagcgcatttattgcccgactcatacgctttccgcatagcgtgctggcggaagttcgccatccagtgctgagcagttttgtgagtttgtttccggcaacgacgatgctggtggcgattggttttgttccgtggtttcgcccactggcggtgtgcctgttcagttttggtgtcgtggttcagttggcttatgccgcctggcaaactgcgggattatggcgcggatctcaccctgaagaagctaccacgcctggactgtatctgccgacagttgccaacaactttatcagcgcaatggcctgtggtgcgttgggctacaccgacgccggtctggtgtttttaggcgcaggcgttttctcatggctaagccttgaaccggtgatcttgcagcgtctgcgcagttcgggagaattacccacggcactgcggacatcactcggcattcagctcgctcctgcgctggtggcttgtagtgcctggctgagcgtcaacggcggcgagggtgacacgctggcgaaaatgcttttcggttatggactgctgcaactgctgtttatgctacgtctgatgccatggtatctctcccagccatttaatgcttcattctggagtttctcgttcggcgtatctgcactggcaaccaccggtttgcatctggggagtggcagcgataatggatttttccatacgctggcggtgccgctgtttatctttaccaattttattattgcaatactgctcatccgtacttttgcgcttctgatgcagggaaaattgttagtcagaaccgagcgcgccgttttaatgaaagcagaggacaaagaatgatcattcgtgacgaaaactattttactgataaatatgaattaacccgcacacactctgaagtactggaagcggtgaaagtggttaaaccgggtaaaacgctggatctgggctgtggcaatggtcgtaacagtctttacctggcagccaatggttatgatgttgacgcatgggataaaaatgccatgagtatcgccaacgtcgagcgcattaaatccattgaaaatctggataatttacacacccgagtcgttgatctgaataacctcacatttgatagacagtacgattttattctttcgactgtggtgctgatgttccttgaggctaaaaccatccccgggttgattgccaatatgcaacgttgcactaaacctggtggttacaacctgattgtggcggcgatggataccgctgattatccatgtaccgtcggcttcccgtttgccttcaaagagggagaattacgtcgatattacgaaggctgggagagggtgaaatacaatgaagacgtcggcgagctgcaccgcaccgacgccaacggtaatcgtattaaactgcgtttcgccacgatgctggcacgtaaaaaatgacccggtaagcacaaaacgcgtgaaaattccccacgctgagatgatttactgttcttcttttcggtaagcatattttttatcgaagggatgtgaaattaatcacagtagtcgaagtttttagcagcttaacttactgaaatttaagtactgatgattgacttagcccctttttcggcattgactatgtcgtctgaaaaggggctgaaaaatttattttcaccaacactttttttgccacaacacgaagcggcgctttttgctataacttagaaagtaatataatcatctcaggaaactattcatgcgtaccacatcatttgcgaaagttgcagctttatgcggcttattggctctgtctggttgtgcatctaaaatcacccagccagataaatattctggttttttaaacaattactctgatttaaaagaaacaacctcggctacaggtaaacctgttttacgttgggtagacccgagttttgatcaaagcaaatatgacagcatcgtctggaacccaatcacttattatccggtaccgaaaccgtcgacccaggtagggcagaaagttctggataaaattttgaactataccaacaccgaaatgaaagaagcgatagcgcagcgtaaaccactggttaccaccgctgggccgcgtagtctgattttccgtggggccattaccggtgtagataccagcaaagaagggctgcaattctatgaagtggttcctgttgcattagtggttgcggggacgcaaatggctacaggccaccgtaccatggatactcgcctctattttgaaggtgagctgattgatgcagcgactaataaaccggttatcaaagtcgttcgtcagggcgaaggtaaagacctgaataacgaaagtacgccaatggctttcgaaaatattaaacaagttattgatgacatggcgaccgatgccaccatgtttgacgttaacaaaaagtagttccagacgcgccatcgttagatggcgctttttatccggtgcgccgtaaaaccccatccttcagggcggggatataaggcgcggttttccacctgaccaggtgtttgctgttgttcaatgtattggcggatgacggatattggcgcacctccgcagctactggcaaaatagccaggactccacaaaacgcctttgtagtaatacctgaatgcaatatctggtcgatctcgtcgcagtcacctacccgatacgcctttgaggctgtttaccagactggatatcgccagtttgggaggatagttaattaacaaatggacgtgatctggttcgccatccatttcaaccagttcagcttcaaaatcagcacatacatttgaaaagtaagtgcgtagtttttctgtcgcgtcatggtcaaaaatctggcgtcggtatctggtgacaaagagcaggtgaacatgcatcaggaaaacacaatgccttccacgccggatatcggtttcttttttcacagaccaaagtatcatttgacctgtgaaacgattacaggcatttaaattccagttaagacccggtggtcaacaggagtgtgaaatgaggcgcttcgcaggcgcatgtcgtttcgttttcaatcgtgctctggcacgtcagaatgagaatcatgaggccggtaataaatacatcccttacgggaaaatggcttcctggctggttgagtggaaaaatgccactgaaacgcaatggcttaaagattctccctcacagccattgcaacagtcactgaaagaccttgagcgggcttacaaaaacttcttccggaagcgggctgcttttccccgattcaaaaagcggggacagaatgatgcattccgctacccgcagggcgttaagctcgatcaggaaaacagccgtatttttctgccgaaactgggctggatgcgctaccggaacagccgtcaggtcacgggtgttgtgaaaaatgtcactgtcagccagtcctgcggtaagtggtacatcagtattcagacagaaagtgaagtatcaactccggttcacccttcagcatcaatggtcgggctggatgctggcgtggctaaactcgccacgctgtcagatggcacagtctttgagcctgtaaacagttttcagaaaaaccagaagaagctggcgagacttcagcgacagttaagccgcaaggtcaaattcagcaacaactggcaaaagcagaaacgcaaaatacagcgactgcattcctgtatcgcaaatatccgcagggactaccttcacaaagtcacaacggccgtcagcaaaaaccacgcaatgatagtcattgaggatttgaaggtcagcaacatgtcaaagtcagcagcgggtacggtcagccagccggggcgcaatgtccgggcaaaatcaggtttaaaccgttcgatactggatcagggctggtatgaaatgcgccgccagcttgcgtataagcagctctggcgtggcggtcaggtgcttgctgttccgccagcgtatacaagccagcgttgcgcgtactgtggtcatacagcgaaagagaaccgcctgtcacaaagtaaattcagatgccaggtatgtggatatacagcgaacgccgatgtaaatggcgctcgcaacattttagcggcggggcacgccgttcttgcctgtggagagatggtgcagtcaggccgcccgttgaagcaggaacccaccgaaatgattcaggcgacagcctgaacgtagcagggatccacgtccttcagggcgtggaggatgtcaatatcggtttctgtcagcgattaaattcaacaccacgtaacaaacgcctccggcaattaatccccaaaacgcagaaccaatcccgaccagcgtcaatccacttgccgttaccagaaatgccaccaccgccgcgtctcgctcacgctcattatgcagcgcctgatacaaactgccgccgatggtacttaacagcgccagacctgccagcatctggatccaacttacgggcagggcagccatcatcccggtaatggcactaccaaacagacctgcgagcaaatagaaaatgcctgcaacggcagcggccagccaacgttgatctttatccggatgcgcttccgggctttggcaaatagccgcggtgattgccgcaataccgacggaataaacgccgaaaggggaaaaaaccagtgccagcaatccagtaaatacaattaatggcgaaacaggagccgaatatccagctgctttcattgctgcgatacccggtgcgttttgcgatgccatcgtcaccagaaaaagggggagtgcaacgctcaggctgtgagcaaacgaaaaatcaggggtaatataagtggggagaacgggtttaaagacaacatcagttgtgacaacgtcaccttgcgcgatgacgatcacgatcccaataatcatcgcggcaattaccgcatagcgcggcgcaacggccttggttgccagccataccagcaacatacttccacacaacgtaaattgaccgtccagactggcaaacgcctgtaaaccaaagcgtaataaaatcccggcaagcattgccgccgcaagcgagtgcggaataatgcgcatcagacgagcaaagagtcccgttatgccgcagaggactattagcgcgttggtgacaataaaaacgccgatggcttcgttaagtgttagtccctgcaatccggtgaccaacaaagccgcgccaggcgttgaccatgcggtgagaacaggtacgcgataccataatgtcagagtcagcgtactgacgcccattgccagccccagcgccgtcatccagccagagatttgtgcagtggtggctccggcgacaatcgctgcttgccagattattgccgctgaactggcgtagccaattaataccgccagaaaccccgccagtagcgtgggtggaggaatagaaaacagacgcatagtcacctcgtgcgttatagcgtacaggcaccgtagcatttgtccgttataacgcacaagtgataaacttccgttttgccggaggagtcgcatggaaaatctcgctcgctttttatccaccacacttaaacaactacgccagcagcgcggctggagtctttcgcgactggcagaagcgacgggcgtttctaaagcaatgttagggcagattgagcgtaatgagtccagtccgacggtcgcgacattatggaaaattgccaccgggttgaacgtaccattttcaacatttatttctccgccgcagtccgctacgccttcagtttatgatccacaacagcaggcgatggtgatcacttcgctgtttccttatgatccacaactctgctttgaacacttctcgattcagatggcatctggtgcaataagcgaatcgacgccccatgagaagggggtaatcgaacatgtcgtcgtcattgatggacaacttgatctgtgcgttgatggggaatggcagacccttaattgtggggaaggcgttcgatttgctgcagacgtcacgcatatctatcgtaatggtggggagcaaaccgtacattttcattccctcatccattacccgcgcagttaagcgggaaaactatttcgcaacgtcgcgcttgtggctaaaatagccgccatttttcagctactggataagaatgtgaccgtatcttctcatcgacttgaactgttaagcccggcacgcgatgccgccattgcccgcgaagctattttgcacggtgccgatgctgtttatatcggcggccctggttttggtgcccgtcataatgccagtaatagcttgaaagatattgccgagctggtgccgtttgcccatcgttatggtgcaaaaattttcgtcacgcttaacaccattttgcatgatgatgagctggaacccgcgcaacggctgattactgacctctaccagaccggtgtcgatgcgctgattgttcaggatatggggattctggaacttgatattccgccgattgaactgcacgccagtacgcagtgcgacattcgtacagttgaaaaagcgaagttcctctctgatgttggcttcacgcagattgtgctggcgcgagagctgaatcttgatcagatccgcgcgattcaccaggctacggacgcgaccattgaattctttattcatggggcactgtgcgtggcctattcgggtcagtgctacatttctcatgcgcaaacagggcgtagcgccaaccgtggcgattgctcgcaggcgtgccgtttgccatacacattgaaagacgatcaggggcgggtggtttcctatgaaaaacatctgctgtcgatgaaagataacgatcagactgccaacctcggcgcgctgattgatgctggtgtacgctccttcaagattgaagggcgttacaaagatatgagctacgtgaagaatatcaccgcccattatcgccagatgcttgatgccattattgaagaacgtggcgatctggcgcgcgcttcatcaggtcgtactgaacatttctttgttccatcgacggaaaagactttccaccgtggtagcacagattattttgtgaatgcccgtaaaggcgatattggcgcgttcgattcgccgaaatttatcggcctgccggtaggcgaagtagtgaaagtggcgaaagatcatctcgatgttgccgttaccgagccactggcaaatggcgatggcctgaacgtgttgattaaacgtgaagtcgtcggttttcgtgccaatacggtcgagaaaaccggagaaaatcagtaccgcgtctggcccaatgaaatgccagcagatttgcacaaaattcgtccacatcacccactaaaccgtaatcttgatcataactggcagcaggcactgacaaaaacctccagcgaacgtcgggtggcggtagacattgaactgggcggctggcaggaacaactgattctgaccctcaccagtgaagagggtgtcagcatcacgcatacgctggacgggcagttcgacgaagccaataacgccgaaaaagcaatgaacaatctgaaggatggtctggcaaaactggggcaaaccctctattacgcccgcgatgtgcaaattaatttgccgggggcgctgtttgtaccaaacagtctgttaaaccagttccgccgtgaagctgctgacatgctggatgctgcgcgtcttgccagttaccagcgcggcagccgtaaaccggttgctgatcctgcgccggtttatccgcaaacgcatctgagtttcctcgcgaacgtatacaaccagaaagcgcgtgaattttatcatcgctatggtgtgcagctgattgacgcggcgtatgaagcacatgaagagaagggcgaagtcccggtgatgatcaccaagcattgtctgcgctttgcctttaatctgtgcccgaaacaggcgaaaggcaatatcaaaagctggaaggcgacgccaatgcaactggttaacggcgatgaagtattaacgctaaagtttgattgccgcccatgcgagatgcacgtcattggcaaaatcaaaaatcacatactgaaaatgccgttaccgggaagcgtagtggcatccgtaagtccggatgagctgctgaaaacattgccgaagcgaaaagggtaaaacgccagttttctggttactcacaacttattgaatctgcatgatattgcctgccgggtaaggcgttacgccgcatccggcatcaaatgactcaacgttgtcccgcttctggtttgcgcgatttttgccagtaaaaatgctcgcgcaaaccttccgccgactcttccgccacagcacgcaattcatcgctgtccgcttcatgacgcagctgatgatccacattctttacccacacaaattcatgtcctttgtgccctgccatgagttgtcctgaaaacagagcacacgttaataagacaaccgataacgccttcgtaaacatcctgccacctttttcttaccttttgccgctatgatgccgatcgtttcttgaggttattattcagttttgcaaattagcgcaaagaaattctggaatcttccttcctgattttgcattgcattctgccgttgcggcgatttagtgctattttcgagcaaattacacacggaggtaaacactaatgtttactttgttgatatactcagcggcagggaggcgatgtgaaacaaagcgagttcagacgttggctcgaatctcagggcgtcgatgtagcgaatggcagcaaccatttgaaactcaggtttcatgggaggcgcagtgtcatgccgcgtcacccctgcgatgagattaaagaaccattgcgtaaagcaatcctgaaacaactcggtttgagttaatcgccaattaaaaaggttaatgacatgcgagagacagtcgaaattatgcgttatcccgtcactcttacacccgcgccggaaggcggttatatggtttcttttgtggatatccctgaagcgttgacccagggcgaaactgtcgctgaagcgatggaagcggcaaaagatgctttactgaccgcatttgatttttattttgaagataacgagcttatccctttaccttcgccattaaatagtcacgatcactttattgaagtacctttgagcgtcgcctctaaggtattgctgttaaatgcttttttacagtcagaaatcactcagcaagagttagccaggcgaattggcaaacctaaacaggagattactcgcctatttaacttgcatcatgcgacaaaaatcgacgccgtccagctcgcggcaaaggcgcttggcaaagagttatcgctggtgatggtttaattacagttaacgaaaagttgtcatttttaacaactgatatagactgccgaatcatctgcacataattacgattcgataatgaaaaaataccagcagcttgcagaacaattacgcgagcagattgcgtcgggtatctggcaacccggcgatcgtttgccttcgttgcgtgaccaggtggcgctttcaggcatgagctttatgactgtcagccatgcctatcagttgctcgaaagtcagggatatattatcgcacgaccgcagtcgggttattacgttgcgccacaggcaataaaaatgccgaaagcgccagtcattccagtcactcgagatgaagcagtcgatatcaacacttatatttttgatatgttgcaggccagtcgcgatccgtcggtcgttccgtttgcctcggcctttcccgacccgcgacttttccccctccaacaactaaaccgctcgctggcgcaggtaagcaaaaccgccacagcgatgagcgtgattgaaaacttaccgccaggaaacgcagaactgcgtcaggctattgctcgtcgctatgccttacagggcatcaccatttctcctgatgaaattgtcattactgccggggcgttagaggcattaaacctcagtttgcaagcggtaactgaaccgggcgattgggtgatagtagagaatccttgtttctacggtgcgttgcaggcgctggagcggctacggctgaaggcgttatcggtggcgacggatgttaaagaagggatagatcttcaggcgctggaactggcgttgcaggagtatccggtgaaagcgtgctggctgatgactaatagccagaatccactcggatttaccttaacgccgcaaaaaaaagcacaactggtggcgttgctcaatcagtacaacgtaacgctgattgaagatgacgtttacagcgaactttattttggacgggaaaaaccgctgcctgcgaaagcgtgggatcgccacgatggcgttttgcattgctcttcgttttcgaaatgtctggtgcctggttttcgtattggttgggtcgccgccggaaaacatgcacgtaaaattcaacgcttgcagttgatgagtacgctttccaccagctcaccgatgcaacttgcgctggtggattacctttccacgcgccgatacgacgcccatcttcgtcgcctgcgtcgccagcttgcggaacgtaaacaacgtgcctggcaggcactgctgcgttatctgcctgcggaagtgaaaattcatcataatgacagtggttactttctctggttggagctccccgagccgttagatgccggcgaattaagcctggcggcactgacgcatcatatcagtattgcgccgggtaaaatgttttctaccggtgaaaactggtcacgttttttccgttttaataccgcgtggcagtggggagagcgtgaagaacaggcggtaaaacaattaggcaaacttattcaagaacggctgtaatagcgtttaatttaattcctcttagattgggtaatatgaatttcgaatagcagtcatatttcctaactccttgactatactccagaagataaccttacagacggcataatgcgcggtagctcacaacctgaataaattttctcaggggcgaaggtgtgcctgcaagccgccgtctatggttaaacaaggagatatttttacggcacggcggctgaacaattaattacgacaggagtaagaccttatgagcaagacatttgcccgcagcagcctgtgtgcgctcagcatgacaataatgaccgctcacgccgccgaaccgcctaccaatttagataaaccggaagggcgactggatattatcgcctggccgggatacatcgaacgcggacaaactgataaacaatacgactgggtaacgcagttcgaaaaagagacaggctgcgcggtgaatgtgaaaaccgccgcgacttccgatgaaatggtcagtctgatgaccaaagggggttacgatctggttacggcatccggcgatgcctcgctgcgtttgattatgggtaaacgcgtgcagccgattaataccgcattgattcccaactggaaaacgctcgatccgcgcgtggttaaaggcgactggtttaatgttggcggcaaagtttacggcacaccttaccaatgggggccgaacctgctgatgtacaacactaaaaccttcccgacgccgccggatagctggcaagtggtttttgttgagcaaaatctgccggacggcaagagcaataaaggccgcgttcaggcttatgatggccctatctatattgcggacgctgcgttgttcgttaaagccactcagccgcagttgggcatcagcgatccgtatcaactcaccgaagaacagtaccaggcggtgctgaaagtgctgcgcgctcaacacagtttgatccatcgctactggcatgacactaccgtgcaaatgagcgatttcaaaaacgagggtgtggttgcttccagtgcctggccctatcaggccaacgccctgaaagccgaaggccagcctgttgctaccgttttcccgaaggagggtgttaccggttgggctgataccaccatgctgcatagcgaagcgaaacatccggtttgcgcctacaaatggatgaactggtcattaacgccaaaagtgcagggcgatgtggcggcctggtttggctcgttaccggtagtgccggaagggtgtaaagccagtccgttattaggcgaaaaaggttgtgaaaccaacggttttaactatttcgacaaaatcgccttctggaaaacgcctatagcagaagggggcaagtttgttccctacagtcgctggacgcaggattacattgccattatgggcggtcgctaacttcgctggggtgctttatgacgtacgcagtggagtttgacaacgtctcgcggttgtacggtgacgtgcgcgcagtagatggcgtcagtattgcgataaaagatggtgagttcttctctatgctggggccgtccggctccggcaaaaccacctgcctgcgcctgattgctggcttcgaacagctttccggcggggctatctctatctttggtaaacccgccagcaatctgccaccgtgggagcgggacgtgaatactgtctttcaggactacgcgctatttccgcatatgtcgattcttgacaatgtcgcctatgggctgatggtcaaaggcgtgaataaaaagcagcggcacgcaatggcgcaagaggcgctggagaaagtggcgttggggtttgtacatcaacgtaaaccgtcacaactttctggtggtcagcgccagcgggttgctatcgccagagcattggtgaatgaaccgcgcgtattgctgttggatgaaccgctcggcgcactggatctcaaattgcgtgagcagatgcagctggaactgaaaaaactgcaacagtctctcggtatcacttttatcttcgttacccacgatcagggcgaagcgttatcgatgtccgatcgtgtggcggttttcaataatggacgcattgagcaggtcgattccccgcgcgatctctatatgcgcccgcgcacgccgtttgttgccgggttcgttggtacatcgaatgtttttgatggactgatggcagagaaactttgtggcatgacgggaagcttcgccctgcgaccggaacatatccgcctcaacacccctggtgaactgcaggccaatggcacgatccaggcggtgcaatatcagggcgcggcaactcgttttgaactgaaattgaacggcggtgaaaaactgcttgtgagtcaggccaatatgacaggcgaagaactgcctgccacgctcacgcccggacaacaggtgatggtttcctggtcgcgtgatgtgatggtgccgctggttgaggagaggtgaatggcgatgaatgtattgcaatcaccttcacgtccaggtctgggtaaggtgtccggtttcttctggcataatccggggctggggctgtttttactgctgcttggcccgctaatgtggtttggcattgtctatttcggctcgctgctgacactgttatggcagggattttatacttttgacgatttcaccatgtcggtaacgccggaactgacgctggcgaatatccgtgcgctgtttaatccggcgaattacgacatcattctccgcacgctgactatggctgtggcagtcactatcgccagcgccattctggcttttccaatggcgtggtatatggcgcgctataccagcgggaaaatgaaagcgtttttttatattgcggtaatgttgccgatgtgggcgagctacattgttaaagcctatgcctggacgttattgctggcaaaagatggcgtggctcagtggtttttacaacatcttgggctggaaccactgctgactgcgttccttacattacctgcggtgggcggaaatacgctgtcaacttccgggctggggcgctttctggtgtttctctatatctggttgccgttcatgatcctgcccgttcaggcggcgcttgagcgtttgccgccgtcattgttgcaggcgtcggctgatctcggcgcacgtccacgacaaacctttcgctatgtggtgctgccgctggcaatcccgggtattgccgctggctctatctttaccttctcactcacactgggcgattttatcgtcccgcagctggttggtcctccaggatattttatcggcaatatggtttattcccagcagggggcgattggcaatatgccgatggcggcggcattcaccctggtgccgattattctcatcgcactgtacctggcgttcgtgaaacgtctgggagcgttcgatgcactctgaacgcgcaccgtttttcctcaaactggcggcctggggcggcgttgttttcctacattttcccatcctgataatcgccgcctatgcgtttaacactgaagatgcggcgtttagttttccaccgcagggcctgacgctgcgctggtttagcgtggcagcacagcgtagtgatattcttgatgccgtgacactgtcacttaaagtggcggcgctggcgacattaattgcgctggtgttagggacgctggcagctgccgcgctgtggcgacgagactttttcggcaaaaacgccatttcgctgttactgctgctgcccattgcgctgccgggcattgtcactggtctggcgttattaaccgcctttaaaaccatcaatctggagccgggatttttcaccatcgtggtcggtcatgcgactttttgtgtagttgtggtgtttaacaatgtcatcgcccgttttcgccgcacctcctggagtctggttgaggcgtcaatggatcttggggccaatggctggcaaaccttccgctacgtagtgttgccgaatctcagttcggcgttactggcaggaggaatgctggcgtttgccttgtcgttcgatgaaatcatcgttacgacctttacggcaggtcatgaacgaacgttaccgttgtggttgctcaatcagcttgggcgaccgcgtgatgtaccggtaactaacgtggtggcactgctggttatgttggtaacaaccttgccgatcctgggggcctggtggctaacccgcgaaggcgacaatggtcaataaccactgatacaggaatatgctatgcaacataagttactgattaacggagaactggttagcggcgaaggggaaaaacagcctgtctataatccggcaacgggggacgttttactggaaattgccgaggcatccgcagagcaggtcgatgctgctgtgcgcgcggcagatgcagcatttgccgaatgggggcaaaccacgccgaaagtgcgtgcggaatgtctgctgaaactggctgatgttatcgaagaaaatggtcaggtttttgccgaactggagtcccgtaattgtggcaaaccgctgcatagtgcgttcaatgatgaaatcccggcgattgtcgatgtttttcgctttttcgcgggtgcggcgcgctgtctgaatggtctggcggcaggtgaatatcttgaaggtcatacttcgatgatccgtcgcgatccgttgggggtcgtggcttctatcgcaccgtggaattatccgctgatgatggccgcgtggaaacttgctccggcgctggcggcagggaactgcgtagtgcttaaaccatcagaaattaccccgctgaccgcgttgaagttggcagagctggcgaaagatatcttcccggcaggcgtgattaacatactgtttggcagaggcaaaacggtgggtgatccgctgaccggtcatcccaaagtgcggatggtgtcgctgacgggctctatcgccaccggcgagcacatcatcagccataccgcgtcgtccattaagcgtactcatatggaacttggtggcaaagcgccagtgattgtttttgatgatgcggatattgaagcagtggtcgaaggtgtacgtacatttggctattacaatgctggacaggattgtactgcggcttgtcggatctacgcgcaaaaaggcatttacgatacgctggtggaaaaactgggtgctgcggtggcaacgttaaaatctggtgcgccagatgacgagtctacggagcttggacctttaagctcgctggcgcatctcgaacgcgtcggcaaggcagtagaagaggcgaaagcgacagggcacatcaaagtgatcactggcggtgaaaagcgcaagggtaatggctattactatgcgccgacgctgctggctggcgcattacaggacgatgccatcgtgcaaaaagaggtatttggtccagtagtgagtgttacgcccttcgacaacgaagaacaggtggtgaactgggcgaatgacagccagtacggacttgcatcttcggtatggacgaaagatgtgggcagggcgcatcgcgtcagcgcacggctgcaatatggttgtacctgggtcaatacccatttcatgctggtaagtgaaatgccgcacggtgggcagaaactttctggttacggcaaggatatgtcactttatgggctggaggattacaccgtcgtccgccacgtcatggttaaacattaaggataatattgcagatcgtaagagtatgagatgatcttgcgtactgtcagagcactgatttctctgacagtacgtgctgcgtgcaaaatcactacatcaaataaaccagccaaatctcatagagataagagtaaacaaaccaacagcagcaaagaaatttatcagtactacagttctactggaaacattcatttttgccaccttttatcattgcccctatgtgtatagtacgggttaagaaaatccgcaataatactcattctgaagatggataagggcaagttgctgtttgatgattttttctcaaactggtgaaaaaacttgatgcacgtcaaaaaatgacgcatatttgcgcgcgttttattcatctggctggacgcccgtacatgtctctctatcaacacatgcttgttttttatgcggttatggcagcaatcgcatttcttatcacctggtttctttctcacgataagaaacgcatccgtttcttaagcgcctttctggtgggggcaacatggccgatgagtttcccggtggcgctgttgttttcactgttttaaatcttactcactggcttgacggcaccacgcagacttatatcatttggatgaatcgataaatttcacaagtggctaaggagaaagtatgtcgcatctggatgaagtcatcgcgcgcgtggatgccgcgattgaagagagcgtcattgcccatatgaacgaattattaatcgccctgagcgatgacgcggagttaagtcgggaagatcgctacacccagcagcaacgtctgcgcacagcgatcgcccatcacggtcgcaagcataaagaagatatggaagcgcgccacgaacagttaaccaaaggcggcaccatcctctgattaaaatgagcgtctggctaccaaccaggcgccaaccacaagtaaaattgcgccacaaattgggccgaacaacgcccgtagtggtacgccatgactgcggaagatatccagcatcagaccgccaatcagctgactggcgaccagtacagcaatagttgtcgccgctcccacattctgatatccgctgatactggcgaagacaaaaaacgatcccagcaagccaggtataagtgtccaccagcgcacgctggacaccagttcgccaaaccccgccatgccttgtttaaaccataaaatagaaacaaagagcacaatccccaccagtgagttcagcaacatggcgatgagaatggtagaggaggtctgggtgatgcgcaccatcagcgtgttctggacaaccagaccaattccggcggcaatcaaaaaagcaagggtgagcgactgattcatccaatcgcgtccggttcagtgcgctcgtcgagttgcaactgcataaatgtcagatccagccaacgaccaaatttagtgcctacctgcggcatttgcgcggtgacgacaaatcccagcgactggtggagatgcagcgaggcctgattttgcgattcgatcccggcgaccatgacatgcttcccgcaatcccgcgcttcatcaatcaatcggcttaacaatttacgccccagacctttgccctgatgatcgggatggacataaaccgaatgttccacggtatggcgaaaaccatcgaaactacgccagtcgccaaacgaggcatatcccgtcactacgccgttttcctcgctcaccagcactggataacctgctaaagtccgcgcttcaaaccaggcaatgcggttatcagcatccaccgtttggtcattccagatagccgccgtatacaacacggcgtggttataaatttccgcaatggcagcacagtcggctttgcgggcaaaacggatggacatgtctggcctcaataaaataatgatgatgatgttatcaatactatcgaaaacagcccgaagcaacggattcctcgatgaaattattgcgtgttgcagaggggatgtgacggctgcaaacaaaaccaatcccgtgagcctgctactattgatggattcatgccaaaagcacaggagagcattatggggcaacaaaagcagcgtaatcgacgttgggttctggcctcgcgtccacatggcgcacctgttccggagaatttccgtcttgaagaagatgatgtcgccacaccgggtgaaggacaggtgttactgcgcacagtttatttgtccctggacccgtatatgcgtggacgtatgagcgatgagccatcttattcaccgcctgttgatattggcggcgtgatggtcggcggtacggtgagccgtgtcgtggagtcgaatcatcctgattatcagtctggcgactgggtgctgggctacagtggatggcaagactatgacatatccagtggtgatgatctggtgaaacttggcgatcatccgcaaaatccatcgtggtcgctgggtgtgctagggatgccaggctttaccgcttatatgggcctactggatatcggtcagcctaaagagggcgaaacgttggtggtagctgcggcgacaggaccagtgggggcgacggtggggcaaatcggcaaacttaaaggttgcagagtggtgggggtagccggtggcgcggaaaaatgccgccatgctaccgaggtgttaggcttcgatgtttgtcttgatcaccacgcggatgattttgccgaacaactggcgaaagcgtgcccaaaaggtattgatatctattatgaaaacgtgggcggtaaggtattcgatgcggtgctaccgttacttaatacatctgcgcgcattcccgtctgcggattagtgagcagctataacgctacagagctaccacccggtccggatcgtttacctctgttgatggctacagtgctgaaaaaacgtattcgcttgcaaggttttattatcgctcaggattatggtcaccgcatccatgagtttcagagggagatggggcaatgggtgaaagaggataaaatccactaccgcgaagaaattactgacggtttagagaatgcgccacagacgtttatcggcctgctgaagggtaaaaacttcggcaaagtggtgatccgcgtggcgggtgatgattaaagtttcaacggcggcgtaagccgccataaaaatccaggcaaaaagcttattttcagctttaattaactaaccacatcattgttctgctgctaataacaacaaaggtgagtggtttatgattattcactttaatacaccaggtgaattccttctgccatgcaggcagggttggacagaaaacacgcgaaggaattaaaatgcctggaacgggaaaaatgaaacatgtcagtttgactctgcaggttgagaacgacctgaaacatcagcttagtattggcgcattaaaacctggcgcacgcctgattactaaaaatctggcggagcaattaggtatgagtattacacctgtgcgtgaagcattattacgtctggtttcggtgaatgcgctttctgtcgcacctgcacaagcatttacagttccggaagtggggaaacgtcaattagacgaaatcaatcggatccgctacgaactggaattaatggcagttgctctggctgttgaaaacctcaccccgcaagaccttgcggaactccaggaattgctcgagaaattacagcaggcgcaagaaaagggcgacatggaacaaatcattaatgtaaacaggctatttcgcttagcgatttatcatcgctcaaatatgcccatcctgtgtgagatgattgagcaactgtgggtcaggatggggcctggtttacattatctctatgaagcgattaatccagcggaattacgggagcatatagaaaactatcatctgttactcgctgcgttaaaagcaaaagacaaagagggatgcagacattgtcttgctgaaattatgcaacaaaatattgctattttataccagcaatacaatcgttaaagtaaatgcccggcaaataccgggcatcaaggtaattactcaaatctccacgcaatattcatgccgacaccataatttcgtccgggcgaaggttcgtaatatcgcccgtttgactcattgacaatgacagaaccaacgtattctttatcgaataaattatcgacacgaccaaataaatccacagttaaattgtggtaattgtatttatacccggtgaataagccgacgagagtataagacggcgcttttgccgtattttcatcatctgccataatatcgcccatataacgcgcttccgtgcctgcataccaaccatcttccggtacataacctatcgacgcaaagcccatattacgggcgatccctggcatccgattaccgttacaatcctgttcattgcaaacattgctgcgataggtcgcatcaagccaggtccaggacgcgtttacgcgaaaatctcctgcgaaacgttgatcccatgccagttcagcgccttgacgacgggtctttccggcatttttgtaagtcgtacgcccaccgctactgctatcgacaacaatttcatcatcagtgtcggtctgaaacaatgcgagactaagcagcccatcaccaatacgcgttttactgccgatctcaattgtatcgttggtggatggttttaaacctaagttcataccgctttgcccatcagcacgataagacagctcattaatcgtcggcgtttcaaaacctcgcccggctgccagatagatattccaggcatcggtcattgcatattttaacgaaccggcaggtagccatttatgataactggcatcaccgctgtcatcgccgttacccggagtaacgtaatggtcgttggaatcaaaccacacggagctgtagcgcacgccagcatccagcgacagtttttcgctcagctgccactgcgtctgtaaatagggatcgatgttccacatcagattgcgttcgtcgcgacgcaactcacctttttgcccgtactccggcatgccgctattcaggcggaagttattgtagcccttgcggttttcactcatgttttcgtagttcaggccggtagtgaacgtgaccggaacgcccagttcaccacggtgtgtccagcggctgtctattccctggtaatggcgttgcagggtaatcacgccgcccgcatgtgacgggttaagttgtggtgccatgggtattgactggtactgggtcgtttctcgctctccggcatacatcatcacactcatatcatcccgcgaactcaggctacgctcatagcgcaacccagcctgagtttgcttgatggtttttcgcgtgtcgtactgttctgcacgaggcgcttgttgtggattagccttccattctgctttggttagcccacctgggtcatctgctttgatatccacactattgaaaatcagacttaatttgctggcttcatcaatgcgtacgcccagtttggcattggctaaatttttctgtgcgccactatggtcacgatagccgtgggtcgtaaaacgcgtggttgagacggtgtaatcgacatcgccaggctgtgtgccgtctcccgttgcgcccgttgctttcagcccatagcgccagctgccaaaactgccgtagtaactactggcttcaatggttggtggctgttgtccggtctgggtggtgacattcattaccccaccagacgcgttgccatacagggcagagaaggggccacgcagcacttccacattttgcacactgcttaaatcgatgttggatgtttgcccttgcccgtcgggcatggtggcgggaataccgtccacatacaggcgaataccgcgaataccgtaagtggagcgggagccaaatccgcgaatcgacagctgtaaatcttgcgcatagttctgccggttttgtacctgcaaaccaggcacgccggtcagtgattcggacaagttaatgcgcggtgttgccaggcgcatctcctcgccatccaccacgcttactgctgctggggtatccagttctgaaaccacctgcggtgcggcactgacaatcatagtctgttcatcagcggcaaaaacaacgggggaaaggacaagcagtgcgggcaaaacggtctgtcggacggaaaaaatcttcatgaaaaaagccaggttaagaatgggaaaacgccgtcatggtaatgaaattgtaaatttatggaaaatgaaacggcacaatacgttaagtaattgagaaaattgtagtcgtaacggcaagaaatgctccacatttgagaaaataatgattaccattcccatttataacaagagcgtaacgatgattacgcttagcgaagcattgtgaagcagcaaaaatatcggttcatcaaagggagtcgtcatgcatttacgtcatctgttttcatcgcgcctgcgtggttcattactgttaggttcattgcttgttgtttcatcattcagtacgcaggccgcagaagaaatgctgcgtaaagcggtaggtaaaggtgcctacgaaatggcttatagccagcaagaaaacgcgctgtggctcgccacttcgcaaagccgcaaactggataaaggtggcgtggtttatcgtcttgatccggtcactctggaagtgacgcaggcgatccataacgatctcaagccgtttggtgccaccatcaataacacgactcagacgttgtggtttggtaacaccgtaaacagcgcggtcacggcgatagatgccaaaacgggcgaagtgaaaggccgtctggtgctggatgatcgtaagcgcacggaagaggtgcgcccgctgcaaccgcgtgagctggtagctgacgatgccacgaacaccgtttacatcagtggtattggtaaagagagcgtgatttgggtcgttgatggcgggaatatcaaactgaaaaccgccatccagaacaccggtaaaatgagtaccggtctggcgctggatagcgaaggcaaacgtctttacaccactaacgctgacggcgaattgattaccatcgacaccgccgacaataaaatcctcagccgtaaaaagctgctggatgacggcaaagagcacttctttatcaacattagccttgataccgccaggcagcgtgcatttatcaccgattctaaagccgcagaagtgttagtggtcgatacccgtaatggcaatattctggcgaaggttgcggcaccggaatcactggctgtgctgtttaaccccgcgcgtaatgaagcctacgtaacgcatcgtcaggcaggtaaagtcagtgtgattgacgcgaaaagctataaagtggtgaaaacgttcgatacgccgactcatccaaacagcctggcgctgtctgccgatggcaaaacgctgtatgtcagtgtgaaacaaaaatccactaaacagcaggaagctacccagccagacgatgtgattcgtattgcgctgtaatagatatggcgagggtgaaaacggtgagacttgcctgccttttatcacggcgtatccggcactttcgtcagtaatctgaatttgcccggcacgtagccgggcaattttgcaattaactcgccgtttcaggcttaaacacaatttcctgtttttcttcatcttcctcgacgactggcgcagtgctgtgaatttcagcaacgcgtttgcgcacaccaaaccagcctataaccagcaaaataccgataatcggcagcgccgcgatagtataagtcccgttcgggtaatcgaacgccatcagcacaaggacactcagtaaaaacagtaatgtcagccaggaagtgaagggcgcgccaggcagtttaaaactgacatccgctgctttgccttctttaatcgctttacgcaggcgcatctggcacacgatgataaacgcccatgaagcgatgattcccagcgacgcgaagttcaacacaatctcaaatacgcgcgacggcaccagatagttgaggaatacgccgacgacatacacaactagtgtcgccagaatcccggcatacggcacatgctgacgactcattttcgccataaaactcggtgcggaaccgcccatcgccattgagcgcagaatacgtccggtgcagtacagacctgaattcaggctggagagggcagcggtcagcaccacaatgttcataatgctgccgatatatggcacacccagtttagagaaaaacgtcacgaacggactttgccccgcctgatacgcgctccacggcaataacataaccagcaacaccacggagccgacgtaaaacaggccaatacgccaaatcacactgttaatggctttaggcaccatggtctgcggatctttacattctccggcagctgtacccaccatttcaatggaggcaaaagcaaacactacgccctgaatcaacaccagcgcaggcagcaaaccgtgggggaagaagccgccattatcggtgattaaatgaaagccagtggtgttgccatccagcggctgaccactaccgaggaacactgtacccacgaccaaaaaggtcacaatggcgagcactttaataagcgcaaaccagaactccatctccgcaaaccatttcacaccgatcatattcatggtgccaacgatggtaagtgcagcgagcgcaaagacccactgcggcacgccgccaaacgcaccccagtaatgcatatacagagcgacggcggtaatatcaacaatccccgtcatcgcccagttgatgaagtacatccagccagcaacataagcggctttctcacccaaaaactcacgggcataagaaacaaaactgccactggaagggcggtgtagcaccagctcacccaatgcacgcagaataaaaaacgaaaacaagccacaaattaaataaaccagtgccagtgcgggccccgccatttgcagtcgggctcctgcacctaaaaacaagccggtgccaatcgcgccgccaatggcgatcatctgcacctggcgattgcccatcgctttgtgatacccctcttcgtgggcattaagccagcggcgtttcgcggcgtgttgatctgaagtgtcggtgtcgtgtttactcattgctctccctgattgctttaatgaaaaagtcatataagttgccatgaacaatgtttattcatcctggcgatgatagttatcaccattattctttatgggtataaaactatcggcgcagcatcctacccgttatcgataaacgatgcaaaacatccccttacaatcctgaaggggattaatacaactgacgaaaaaatgacaaatccttttgctggttaacctgtgtactgtcctacacttaatctttaaaagattgtgaggggcatatgattaaggtgtatggcgtacccggatggggctctacaatcagtgagctgatgctaacactggctgatattccttatcagttcgttgatgtcagtggttttgaccacgagggagcttcacgcgagttattgaaaaccctgaacccgttgtgtcaggttccgacactggcattggaaaatgacgagattatgacggagacagcggcgattgcattgatggttctcgatcgtcgcccggaccttgcgccaccggttgggcgcgccgaacgtcagctgtttcaacggctattggtctggctggttgctaatgtctatccaacattcactttcgccgattaccctgagcgttgggctcctgacgcacctgaacagttaaagaagaatgttattgaatatcgaaaatcgctttatatctggttgaattcgcagctcactgctgaaccttatgcgtttggtgagcaactaacgctggtggactgttatctttgcactatgcgcacatgggggcctgggcatgaatggtttcaggataatgccacgaatatcagtgcgattgctgatgctgtatgtcagttaccgaaattacaagaagtattaaaaaggaatgaaattatttgagtgggataccagaagattatgttatttattattcagtaactttatccacaatgatgggcgtaattaattaaattcatggtatgttttttaatttatatcactctccttttcattcagcgtgtctatttcatttcctctgaaaagaaactaactattcacatcgtgcagatgtttcagttgttatcacaggcattctataatctcaaaatgtttttaatgatggatatgctcggagttggagatgcaattaatattaatacaaataaaaatatccggcaggtatgctaaaaggataaatggcgttctctgtatttattcgcaattatctgtaggacaaatatggagagcttgatgagtcagagctaaaacagcaattgattaataaacatgttgatttattcaagaaaatggatgtattttaaatgttgattcttaatataacctaatcaatagattatcaagtgagagctacacattattggaggggcaggggaaaacaccattttgggaacaatgcatcaggtactcttaccactgaagcaagatcatccggcaccaggtggtggtgcagtgctttggaaatggtcccctcgggggagttgtcattattttctatgctatttgcttattatattcatcaggtgaatttaataaattcctaatttgaaatatccactattaagctagtgtttaacgacgttaagatggcaatgtgcagatcatgttatcagggtggggcggtagcgtatattccttatacaaaccatcattcatttcaatgattgttattgaattatttattgttgtgaataaaaagacattatgaatattggtttgactttgcatatcaggttttttattactcgctgtaatgtacgagcctgtcgtgaataacgtcgagaacccatccgttgcgtttgtgattattttgttgactaaacagacacccgtttctctgaagtaaaatcccagactaaatcatcacataaccatgacatttttctgatattccccggtaacgccagatgtcgactcgcttaaccaccctcagccataccagtgaaggccaccgcgtgtcggtccactacggctatgacgataaaggccgcctgaccggcgaacgccagacggtggagaacccggagacgggggaactgctgtggcaccatgagaccggacatgcgtacaacgaacaggggctggcaaaccgcgtcacgccggacagtctgccgccggtggagtggctgacctacggcagcggctatcttgcgggcatgaagctgggcgggacgccgctgctggagttcacgcgcgaccgcctgcaccgtgagacggtgcgcagcttcggcagcatggcaggcagtaatgccgcatataaactgaccagcacatacacccccgcaggccagttacagagccagcacctgaacagcctggtgtatgaccgtgactacgggtggaatgacaacggcgacctggtgcgcatcagcggcccgcgacagacgcgggaatacggctacagcgccacgggcaggctggagagtgtgcgcaccctcgcaccagacctggacatccgcatcccgtatgccacggacccggcgggcaaccggctgccggacccggagctgcacccggacagtacactcacagtgtggccggataaccgcatcgcggaggatgcgcactatgtctaccgccacgatgaatacggcaggctgacggagaagacggaccgcatcccggcgggtgtgatacggacggacgacgagcggacccaccactaccactacgacagccagcaccgcctggtgttctacacgcggatacagcatggcgagccactggtcgagagccgctacctctacgacccgctgggacggcgaatggcaaaacgggtctggcggcgggagcgtgacctgacggggtggatgtcgctgtcgcgtaaaccggaggtgacgtggtatggctgggacggagacaggctgacgacggtgcagactgacaccacacgtatccagacggtatacgagccgggaagcttcacgccgctcatccgggtcgagacagagaacggcgagcgggaaaaagcgcagcggcgcagcctggcagagacgctccagcaggaagggagtgagaacggccacggcgtggtgttcccggctgaactggtgcggctgctggacaggctggaggaagaaatccgggcagaccgcgtgagcagtgaaagccgggcgtggcttgcgcagtgcgggctgacggtggagcaactggccagacaggtggagccggaatacacaccggcgcgaaaagttcatttttaccactgcgaccaccggggcctgccgctggcgctcatcagcgaagacggcaatacggcgtggcgcggggagtatgatgaatggggcaaccagcttaatgaggagaacccgcatcacctgcaccagccgtaccgtctgccagggcagcagcatgatgaggagtcggggctgtactataaccgtcaccggcactacgatccgttgcaggggcggtatatcaccccggacccgattgggttgagaggtggatggaatatgtatcagtatccgttgaatcccatacaagtgatagacccaatggggttagatgcgattgagaatatgacatcaggtggactaatttatgccgtatctggtgtacctggattgattgctgcaaacagcattactaacagtgcttaccagttcggttatgatatggatgctattgttggcggagctcataatggggccgccgatgcaatgagacattgttacttgatgtgtcgaatgactaagacatttggatcaacaatagctgacgtgataggtaaaaatcatgaggcggcaggggatagacaaggtcagccagctaaagaaagaatcatggatcttaaaaataacactgtcggtattgcttgtggcgatttttctgccaaatgtagcgatgcatgtattgaaaaatataacactgggcaactcttcgggttagatggtataaaagcagataatccaataaaagcaaagcaagggagttcagatgcttcaaattattagaggcaaacttgtcatttttttaattaccctttgtttatttgttgtttaccttgggtttgataacaattcaaattctgacatcgtattttatggacataaaacaccaaagagcgttgagatatatctttctgaaaaaaatattatttataaaataattaatgaccaaaaaattagtagagggaatggtcattttataagtataatggttaataattacaggacgcactgtggagtggttgatataaatcttaattttttcaatgatattctttatagcgtgcgattaaaaaacattagtaaactggagaatatggagttctgcgctacaaaacaacgggtgtattttagtgataaaaacaagaaggctagttataaaataattaattatggagactattatgatgttgattattatgataacaatttgaaaaatgaagtttttgactggattggtaaatggtcataatgaacaacaccagaaagagaaaaatataaaatacatacagaaagacatgagagcaagggacggggcagggcaagatcatgaaaattgtgatgtaaatcacgattttcatctttgctttaacgcctacaggtgatcaaaatttaacctttggaataactaaaaagataaaaaaggacgccaggtgagtattcaaagtttgcttgattatatttcagtgacccctgatatacgacaacaaggaaaggttaaacataaattatctgctattttgtttctcaccgtatgtgcagtaattgcaggtgccgatgagtggcaggaaattgaagattttggacatgaaagacttgaatggctaaagaaatatggtgattttgataatggcattccggtcgatgacaccattgcacgcgttgtgagtaacattgacagtttggcctttgaaaagatgtttattgaatggatgcaggagtgccatgaaatcactgatggtgaaattatagcaatagatggaaagaccataagaggctcctttgataagggaaaaagaaaaggagcaatccatatggtgagtgcattctcgaacgaaaatggtgttgtactggggcaggtgaaaacggaagccaaaagtaatgagattacagccattccagagttgcttaacctactgtatttaaagaaaaatttgataaccattgatgctatgggctgtcagaaagatatcgcttcgaagatcaaagataaaaaagcagattatcttctggcagtaaaaggcaatcaggggaaattacatcatgcattcgaggaaaaatttcctgtaaatgtgttttctaattataaaggcgattcgtttagtacgcaggagataagtcatggaagaaaagaaacacgtttgcatattgtcagtaacgtaacgcctgaacttttgtgattttgaattcgaatggaagggattaaaaaagctttgtgtagcattgtcattcaggcagaagaaagaagataaatcagcagaaggtgtaagcatccgatattatatttcatcaaaggatatggatgctaaagaatttgcacatgctatcagagcgcactggctgatcgagcacagtcttcattgggtgttagatgtaaaaatgaatgaagatgccagccggataagaagaggaaacgcagcctaaataatatctggaataaagaagatggcactgaatttattaagagattgcaaagacattaagggtgaagaggaaaagaaagaaggctgcgttaaacacagggaaagatcatcagaagttcactttttgtactaaacaattcgcattttatgtttaaaaattgagatattccttattacctaaagctgttttttattgcttacacatgatcaaatactccttacataattaaggagaacaaaatggaacttaaaaaattgatgggacatatttctattatccccgattacagacaagcctggaaaatggaacataagttatcggatattctactgttgactatttgtgccgttatttctggtgcagaaggctgggaagatatagaggattttggggaaacacatcccgattttttgaagcaatatggtgattttgaaaatggtattcctgttcacgacaccattgccagagttgtatcctgtatcagtcctgcaaaatttcacgagtgctttattaactggatgcgtgactgccattcttcagatgataaagacgtcattgcaattgatggaaaaacgctccggcattcttatgataagagtcgccgcaggggagcgattcatgtcattagtgcgttctcaacaatgcacagtctggtcatcggacagatcaagacggatgagaaatctaatgagattacagctatcccagaacttcttaacatgctggatattaaaggaaaaatcatcacaactgatgcgatgggttgccagaaagatattgcagagaagatacaaaaacagggaggtgattatttattcgcggtaaaaggaaaccaggggcggctaaataaagcctttgaggaaaaatttccgctgaaagaattaaataatccagcgcatgacagttacgcaatgagtgaaaagagtcacggcagagaagaaatccgtcttcatattgtttgcgatgtccctgatgaacttattgatttcacgtttgaatggaaagggctgaagaaattatgcgtggcagtctcctttcggtccataatagcagaacaaaagaaagagctcgaaatgacggtcagatattatatcagttctgctgatttaaccgcagagaagttcgccacagcaatccgaaaccactggcatgtggagaataagctgcactggcgtctggacgtggtaatgaatgaagacgactgcaaaataagaagaggaaatgcagcagaattattttcagggatacggcacattgctattaatattttgacgaatgataaggtattcaaggcagggttaagacgtaagatgcgaaaagcagccatggacagaaactacctggcgtcagtccttacggggagcgggctttcgtaatcttgccctgggcattattgtcgtataaacgctttaccggacacatgacattcacaatgtgtgttaattttactgacatctttcaaaaggagcgtaatcatgccgcacatcgacattaaatgttttccgcgtgaactggacgaacaacaaaaagcagcacttgctgcagatattaccgacgttattattcgtcatctgaacagtaaagacagttcgataagcattgctctacagcagattcaaccagaatcttggcaagctatctgggatgccgaaatcgcgccccaaatggaggctttgataaagaaacctggttatagcatgaatgcttaacccgccgtaacacgcttgccgctggtaacaaacgtcccagcacctaaatgatgcaacgtattgagcttatcatcatcaaactgccagcggccttcgacaaatacccgtgcgtctgccgctgctgatactacttcgccaaacagcgtgtcgtattcttcttgcgcagaagtcgcaggtagcaatcgacactccatccacgccagacatttttcctcgaccagaggcaaaccaaataccgggcctctcacaaccggaatgccatagcaattaaatttatcttcatcacgccccgacacacttcccaccgcccacgtccagttagttgctgcaacgcccgggataacgatgccaaatttaccgttatgttcaatcaactccctggtccatgtcgatttatctaccacaatcgccacgcgtggaggttcaaactccaccggcattgaccaggctgcagccataatgttacgccgctgggattgctcatcgaaactggtgatcaagaccgttgggccatgatttaacagacggctggcatggtgtaattctatggggatgaatcggctcatggtatcgcctcgcgaagaaggtttttttaagcgtagtccgtaacgcaataagtaacgaaattaacgggattggcgatttgcgaacgtgatgcatgtccgcgatcgcacaaaatagccggtgcggcgtctattccaggttataagttgagaaaaccactaagggaaacgcctgatgacgcccattctgaatcactattttgcccgtattaactggtcgggagctgctgcggtcaatattgatacgcttcgtgcattgcacctgaaacacaattgcaccattccgtttgaaaacctcgacgttttgctgccgagggaaatacagcttgataatcaatcgccggaagagaaactggtgatagcccgtcgtggcggttactgttttgagcagaatggcgtgtttgagcgggtgttacgcgagctggggtttaacgttcgcagcttgttagggcgcgtagtgttatcaaatccgccagcattaccgccgcgcacccatcgtttgctgttggtggaactggaagaggaaaaatggattgctgatgtcggtttcggtgggcagacgctaaccgcgccgattcgtttagtttccgatctcgtgcagaccacgccacacggagagtatcggttgttgcaggagggtgatgattgggtgttgcagtttaatcatcatcagcattggcagtcgatgtaccgttttgatctctgcgagcagcaacaaagcgattatgtgatgggcaatttctggtcggcgcactggccgcagtcgcattttcgccatcatttgctgatgtgccgccatttgccggacggcggcaagctgacactgaccaattttcattttacccattatgaaaatgggcacgcggtggagcagcgaaatctaccggatgtggcgtcattatatgctgtgatgcaagaacagtttggtctgggcgtggatgatgcgaaacatggctttaccgtggatgagttagcgctggtgatggcggcgtttgatacgcacccggaggcgggaaaataatttatgtcaggttgccggatgcggcgtaaacgccttatccggcatacattagcccggttgtagacctgacaggcgaagcgcatcagacaacggtttcagagttcaattgcccattcggcatgaaacaaaatcaccgctgtgcctgaaatggtgactttttccggttggttatcacgaattgtcaccgtcacttcaatcataccgtcacgccccaatgcgcgcccctgatggcctttaacacgcaacacgttgccatcgtggggcaatacgttgtgatgtaccaaccatgcacccatcgggccattggcattgccagtcaccggatcttccacaataccaatcgcaggcgagaacatgcgaccatcggtttcgtttttgcctgggcggatctggaacgggaagaaaccattgcagccaatctttttgctgatagcggtcagcgcattaaggtcaggcgaaagggcgtcgatatccacttccggtttcagtgggatcatcacttttgagtgtcctgttgttgccacctgaattggcaagcctggcagaatatcgtcctcagtgagatgaagcgcgttgataatcgccgcacgtgtttcaccttccagcggtggctcaaagcccggcgtaccttgttccagcgaaatacgataatcatcgttgtgcttttcgatagtcacgcgatgttttcctgccagcgatgtttgccagatcgtgcaatttcctaaacctaacaccttcgcacgtacatagtgcgcagctactgtcgcgtgaccgcaaatcggcacttcaaccgttggcgtaaagtagcggatgcgcacatcgctgtcgtcgctgtgcagcagaaaagcagtttccgaatggcctaactcgcgggcgataagctgcatttgcgcttcgctaagattatcggcggggaaaacaacaccggcagaattgccgcgaaacggttgtgaggtaaaagcatcgacgtggtacacctgcggtttcattaacgttctcctgtgactggagaactatcatagcctgcaagtggccggagagcgaagggctatccggccagggtgaaattatcgccgcgaacgcacaatttgatatcgacgagtaaagtactcaaacggcgcgctccacacatgcaccagtcgggtgaacgggaagagcaggaagatggtcattcccaacaccagatgcaggcggaagacgaacgctacgccgttgagcatctctgacgatccaccacggaaagtgacaatgctttgcgcccaacccaccagcttcatcatttcgctaccatcaggatactgtgctgaaaacggtatggtacttagccccaacagacactggatcagcaaaatgctcatgatgatgatatccggcgtagtggaagtggcacgcacgcgctgatttgtcagcctgcgccacagcagtcctgcgccgccaatcaacgtcaacacaccgcaaataccgccgagcaccatcgccatgagttgtttcgctgccactggcaaaaaccacgcgtacatccagtgcggcgttaacatgccgaacaagtgcccgaagaaaatccccaaaatgccgatatggaacagattcgaccatatcaccatcccgcgtttatcgagcatttgacttgaggaggcgcgccaggtgtactgcccgtagtcgtagcgcagccagctgccgaggaaaaacaccgtcgcacaaatgtacgggtagatatcgtaaaaaaagacgttcagatactgaatcatttcccacctcccgcactgatgtcgacatattgcggcgcgacatcctggctaaagcgtcgctgatattgattaagcggcgagctgtcacacgccgtggcgttatcttcaataaacttcacctgttcctcttcccacactgcatcaagcgcctggcgggtgtcatcgcgctcttcgctgtttacttgttttgtgacactgtcacttgaaagggagcttcccgccagttgcagcagagcatcaaacaacgcgtaccacggtgcctcgcgttgttttaagcgaccgccaagcagggcgaggatcggcgcaacattgagcaatccttctttcgcctgatcgtcaggcagtacgcttaaatactccagatacagcggtagataatcgggcagttcccgacaatccagctgcaggccgaccttttcatactccgccagcaggtccaccattgcctggccgcgatcgcgggactcggcatgaacatgttcgaacagcagcagcgacgtggtgcgcccgcggtcaaacacttcgcaccattcggcctgtttatccagcagcggcgcgttaagcaggttgtgggtgaaatccgtaagcatcggcgcgtcgcggcggatcaacgccagcgcgtcctccttgcattcccacaacagctcgtccggatactccatcaacaggccgatcactttgaggatctgcattattcgccctccgctttgtcgcgcacttcggtgatgttgatggcatcgatacggctactgttgaacaggttgaatttactgtccgaaccgtggcaaccgtcgccaaaggtaaaaccgcagccgttgcgttctgcgaaggcatcgcccgccatttcccgatggctggtcgggataacaaaacgatcttcatagttggcaatggcgagatagcgatacatctcttcgacctgggcgacgctcaggcctacttcgtcgatggcacgagtatcagtaacgccttccacggtttgtgaacgcatatagtggcgcatcgccatcatccgtttcagcgcccgcagtaccggaccggtatcgccggcactcaacatattggcgagatattgcaccggaatacgcaggctttcgatggcgggcagcacgccttcgcttttcggcaaaccgcccgcatctgcgtaggactgaatcggtgacagcggaggaacgtaccagaccatcggcagggtgcggtattcagggtgcaacggtagtgccagtttccagtccatcgccattttgtagactggcgaacgctgggcagcgtcaatcacattttgtggaataccttgtttcagggcttcctcgatcactgagggatcgtgtggatcgaggaacacttcgcactggcgttcatagaggtcaacttcgcgctcggtgctcgccgcttcctcgatgcggtcggcgtcgtaaagcagcacgcccagataccggatgcgacccacgcaggtttctgagcacacggtcggttgaccggactcaattcgtgggtaacagaagatgcatttttctgacttgccgcttttccagttgaagtagatttttttgtacggacaaccgcttatgcacaaacgccagccacggcatttatcctgatcaatcagcacaatgccgtcttcttcgcgtttgtagatagcgccgcttgggcaggtcgccacgcagctgggattgaggcagtgttcgcacaggcgcggcaggtacatcatgaaggtgttttcaaactgcccgtacatctccttttgcatggcctcgaagttgcggtcgcgggcacgtttttcgaactcaccgcccagcagttcttcccagtttggcccccagatcactttgtccatccgtttgccgtcaatcagtgaacgcgggcgagcagtaggaatatgtttgccttccggtgcgctatgcaaatgttcgtagtcgaaggtgaaaggttcgtagtaatcatcaatctgcggcaccaccgggttggcgaagattttggttattacgcccatcttgttgcccagacgcgggcgtatcttgccattcacatcacgcacccagccgccttgccactcttcctgatcttcccagtttttcggataaccaatgcccggtttggtttcgacgttgttaaaccatgcgtactccatgccttcgcgcccggtccagacgtttttacaggtcaccgaacaggtatggcagccgatacatttgtcgaggttaagcaccatgccgacttgtgaacggattttcattttttcgcctcctgtacctgatcgcgaccttcatcatccagccagttaacgttcttcatcttgcggatcatgatgaactcatcgcggttcgatccgacggtgccgtagtagttaaagccccaggccagctgcgcgtaaccgccaatcatatgcgttggtttcgggcaaacgcgggtaaccgagttatgaatgccgccgcgcatgccagttacttccgaaccaggaatattcataatgcgttcctgggcgtgatacatcatggtcatgcccggcggtacacgttggctgaccaccgcgcgggcagtcagcgcgccgttggcgttgaatacttccacccagtcgttatcgacaatggtcagttctcgggcatctgtttcgctgatccagacaatcggtccaccgcgagagagcgtcagcattagcaggttttcactgtaggttgagtgaatgccccatttctggtgcggcgtcaggaagttaagtgctttttccgggaagccgtttggcggtatctggcgcatctcactgacgctacgggtgtcgataggcgggcgataagccaccaggctttcaccaaaagcacgcatccacggatgatcctgatagagctgctggcgtcccgacagcgtgcgccacggaattaactcatgaacgttggtgtatcccgcgttataggagacgtgatcgctttccagaccggaccaggtggggctggagataattttacgcggctgcgcctgaatatcgcgaaagcgaatcttctcgtcctctttgtgcagcgccagatgggtatgttcgcgcccggtgatctcgcccagcgcctgccacgctttgactgcaacatgaccgttggtttccggtgccagtgccagaatcacttctgaagcgtcaatggcggtgtcaatcagcggacgcccctgtgccgggccatcacgcttggtgtaattgagtttgccgaggaaatcgatttcatcctgggtattccacgaaatccctttaccgccattgccaagtttgtccatcaatggcccgagcgaggtaaagcgttcatacgtagcagggtagtcgcgctccaccgccacaatattcggcgcggttttgcctggaatcagatcgcattcgcctttgcgccagtcgagcacttcacacggctgtgagagctctgccggagagtcatgcagtaggggttgtaataccacgtcggtttctttgccaagatgacccacgcacacttgcgaaaatgctttggcgatacctttgtagatttcccagtcgctgcgtgattcccacgccggatcgaccgccgcagaaagcggatgaataaacggatgcatatccgaggtgttcatatcgtctttttcgtaccaggtggcggtgggcagaacgatatcggagaacaggcaggtactggacatgcggaagtcgagcgtcaccagcaggtcgagcttgccttcaatcgctgcagtttgccactcgacttcttccggtttgatcccgtcgctggcaccgagttcctcgccctgaatcccgctttcggtccccagcagatacttctgcatatactcgtggcctttgccggaggagccaagcaggttagagcgccagacaaacaaattacgcggatgattgctgctgctatctggttgttcgcaggccatacgtaaatcgcccgatttcagcgcctgggcggtaaattctgtgggggataatccggccttgtcggcttcagctttaatcccgagcgggttacgccccagctgcggcgcagaaggtagccagcccatacgttcggcgcgaacgttgaaatcaatcagatgaccgctgtacttactggcatcggcgagcggtgaaagtaactcctgagcagagactttttcatagcgccattggctggaatgattgtagaaaaacgaggtgctgttcatttggcgcggtggtcggttccagtcgagcgcaaaggccagtggcaaccagccggtttgtgggcgcagtttttcctggccgacatagtgtgcccagccgccaccgctttgcccgacacaaccgcagaagatcagcatattgatcatcccgcggtagttcatgtccatgtgataccagtggttaacacctgcgccgaggataatcatcgagcgcccatgcgttttatgggcggtatcggcaaattcacgggcgatggtttcaatatactggcgcggcacgccggtaatttgctcaccccaggctggggtgtacggtttgatttcagcgtaatctttcgcactgttttcatcttccagcccgcgatcgaggccgtaattcgccagtaccaaatcataaacgctgaccaccggacaggtgttgccatcgactaacgtcaggtttttaacgggcaattggcgcaccagcaccggattgtgttttacgctgcgaaaatgcggattttcaatgccgccaaagtaggggaaggccacgcctgcaacagcgtcatgttgaccgagcagggttaacgacaattcggtttccgtaccggcggcaatggattccagattccatttgcctttttctccccagcggaaaccaatcgaaccgttcggcactaccaattcacctgcggtattaactgctacggttttccactgcggattgttgctttcgcccagtccatccaccaggtcagatgcgcggatcatgcgcccgggaacgtagctaccatcgtcgcgaggctccagcattaccagcatcggcatgtcgctgtagcggcggcagtagttgataaagtagtcgctgggattatcgagatgaaactcttttaaaatcacatggcccattgccatcgccagggcgctatcagtgccttgtttcggtgccagccactggtcgcacaatttggccacttcagagtagtcaggggtaatggcgatggttttagtgcctttgtagcgtacttcggtaaagaagtgggcgtccggcgtacgtgtctgcggtacgttagacccccaggcgatgatgtagctggagttataccagtcggcagattccggtacgtcggtttgctcgccccaggtcatcggcgaggcgggcggcaggtcgcaataccagtcgtagaaacttaaacaggtgccgccaagcagcgacagataacgcgttccggcggcgtaagaaaccatcgacatcgccgggatcggcgagaaaccggcaacgcgatccgggccgtaggttttgatggtccagacgttagcggcggcaatcagctggtttagttcctgccagttggagcggataaacccgccgcgcccacgcacttgtttgtagctcaggcacttttgcggatcgttcataatcgatgcccacgccagtaccggatcgctgtgttgcttgagggcttcgcgccacagttcaatcagtcgtttacgaatgagcgggtatttcaggcggttagcgctgtaaagataccaggagtaacttgcgccacgcgggcagccgcgaggttcatgattgggcaggtcagggcgagtgcgcgggtagtcggtctgttggatttcccaggtcaccagaccatttttaacgtagattttccagctacaggagcctgtacagttaacaccgtgggtggaacgcacgattttgtcgaactgccaacgctggcgatagctgtcctcccagtcgcggttgctatgcatcacctgtccgtgaccatcggcaaaggtttcgcccttttgtttgaagtagcgaaagcgatccaaaagtttactcatgacatgactcctgctccaggaatgaattgggatctgatgccttgtcggatgcgacacggttgtacatcaggcatcgatctcttatttttggctgaacttccgccgaccataaaccagccaggtcagcagcacacaaacgatgtagaagattaaaaacactttcatcgcgccgaccggagagccggtcatattgagcgacatgccaaacgcctgcggaataaaaaagccgcccactgcgccaatggctgagataaagcccagagccgccgccgtttcggtgacggcttctttatgagcttgctcatcactaccgcctttcatctttacccgataaatggttatctggcgaaagatgacggcgatcatctggaaagtagaaccacttcccagacccgcagtcagaaacagccccataaatacggcgtaaaaggcgatgaaattaccggagcctgtgcccggtaaggtaaggaacagcagggcactgaaaatcgccataaaaataaagttgatcaacgtcacccgcacgccgccgaacttatcggaaatagcaccaccaaccgaccgcgcgatggcaccgataaatgggccaaagaacgccaggcgcagaatattcacatccgggaactgggtttttgccagcatggcaaaacccgcagaaaaaccgataaacgaaccgaaggtggcaaggtaaagcaggctcagcagccagagatgcaggcgttgtaagacagggagctggtcggcaattgaggcgcgtgaactggcgatatcattcatccctgaccatgcggcgatcgtggcaatcgccagtagcggtacccaaatccatgcggcattcgccagcgacatcaccgaaccgtcggcctgcggtacgccattgacgccgagaaaggcaaatacaggtacaaaaatgaccagcggtgcaaccagctgcattacacttacacctaagtttcctaatccgccattaatcccaagagcgctcccttgtttggcttttggaaagaagaaactgatattgcccatgctcgaagcaaagtttgcacctgcaaaaccgcatagcaaagcgataacgataaatatcccaaaaggagtattcggattttgcacggcaattccgagccagacgcaaggaataatcaggattgcagtactaaaaaccgtccatcggcgtccaccgaatataggcaccataaaggagtagggaacacgcaataatgcgccagaaacggagggtaatgcggttaataaaaagagttgatcggtagtaaaattaaaaccgattttattgagattaacggtaactgcgctaaatagcatccagacacagaaggcaagaagtagacaactgactgatatccagagatttcttcgagcaatatgttttcctttattttcccagaaggccggattttctggtttccagtcgcgcaaaagataacgactatttttctcattttgcagtgccatattgttcctcacatgcacacattggtaatgaaaaaaagacaaaacacgaggtaaggcgcaatagccagttattagaattaaggatgaattgggtgaagtgctgattgaaagaatagataagaaagcgtaaccgcgggggcagaatggggattaagtagccagatatgtgttactaaatgtaactaacaagctaaccttcaaacggggttaatctttgaacgtatgtcatgtttcaacccttcagatcgtgaatctaaagggttacatattaactatattatcaacaagaccagacacttatagaattagtgatgatttattcactaaaaaggccatgaactggaggaaaacgatctgtccagaaggtctatcggttcctctcttattgcctgattgtaataatcgttattacagtaagtattgtttatttcatctaaggtcatgtttttaacttttatattcatctggtttacaacttcctctgtcttgtaagtgtgtatattatatggggtatatgcttttttaataggatagtgaaacaattcgttatccacatctattccgtcagagtgaacttcaaatgcaccaggcgaaagaattgccaggccagtattaagcttaagtgctggggaaaacaaattaaataacatgagctgcatagtagggcaattgttcttcccagaaacatttaaaaaatttaagttttgctctgttttattatggggaataaagttccaatatcggatgtattattagtatcaatgtgggttattttattattgtccagtcttaaacttttgatagatggaagataagtcaggaaatcaagatttatatatttcaactggttgttagcagcgtttaatgtctgaacattgcagaagttgctatagaatattttaatttcagaaagcaaattgttgttaataagtaacgtattcaagttgggaaataagtcattgtgtaaacttgttagtttattatgggatagatccagcagtaagagttcatttttattacctgcaacaatatcagttaattgattatggctgagattcaggtattgcagccattcgcaagattctaattgcacaaactctagttgattatgtgccgcactaaaataagtaactgatgaaagcctatctatatcaatatttctgagagcattattattcatagatatatgtgtaatacttacatttctgccttgaggaaaatttattgactcaagagcattactattcagacttagctttacgagtctatcgtagttggttgcatcaaaatgtgtgaattggttattatcaagattgatagatgtgaagttttgcagccctggtggttgagtggttaaattaagtcctgataaatcaatggtcacttcattagtgtcatcaattatatttcttactgcagtccagtactgcatttgtgcaagtggatcattgttgatgccgttaactaatacatgccaaagatgttttgatgatattagttgatcaatgtcattggttggcagtaaattgttattgcttaagtttaaatattccagttttgtagtgtttttggcgtttaaatgtgcaatatggttgtcgtttaaagtgattgttttcatcctgggatgattgtgtaatataaggtcagtgatcatattgtgatgggcacttaactcaatcagagattcttgccgcgcgagccgttggcttcatcgttatagcctttaaaatcatattcccagtgaccaaaaccaatcatttgatcattgatttgcgtttctcctttaaagccgagacgggcataagttttatcaccatcgtcacgcttatcatcagtaaaataacgtagagcggtaaccttgccataaaggtcgagtttattaccatccttgttatagacttcggcagcgtgtgctacgttcgcagctaacaaaccagttacaaccaccgcaactatttttaatttcatttaacagaatccttttaattatcgttaaacgtattttctaaacgaattttaaacggcgtcatttataaatgacatactgtttttaaaatagaatggtgattaaaaacaatgagaaaaatagatgaaataatattatttatcgatatgtgatcgaagtcgaaatgagatataaggtgaattactggtatttgaaatttatttttttaatattgtcggaatttatctgattaactaccgggccgtagacccggcagttattttaaccacgacgtgtcgccagccagcagagcagggaaccgccgcagaccatcagcgcgccttgccagaacgagaacgacagcggggcgctgagcagcacggctgcaagcgctgaggaaagtacaggcgtaaaatacgaacctaccgccataatggtgacattgccatgcaatataccgacattccatgcagcataagcaaatcctaaggtaaatgccgcagagatgagtttaatcatgacgggcgtgctaaatatcatttctggttgtggcgtaagaaaatagtaaacccacagacttgctcccgttagcaggacaaaaacggtaattccattaaatccgcgtgcgtatttattcgttactgtgcaataggctgcccagataaacgcaccaatgaacgccaggaaataactcaatgggctggtggtgatattattgatgatttcatcataatgtaacccattgtcaccgcctaacacccaacagacgccgacgagggctaataataatccaggtacaatcaaccagttggttttctgaccattaaacagaatggcaaagagaattgtcaggctgggccacagatagttcaccatacccacttcaatcgcctgatgatgggtcgccgcataccctaaggaaagcgccagacagatttcatagctgacgaataacagactcccggcgagtaaatagcctttcgggatttgccgaatacgcggaaatccaaccgtgaagattaacagcagcccgcttaatgaatagatagcagctgcgccgccgaccgggccgagcccctcactgacaccgcgaatcaatcctaccatcgtgctccacaggacgatcgctatcagccctatgagcgttgctttttgtcgtgtcatgctcgctgttttgtctctcttgccgttaaaaattaagctgaattttatagcatttttttaactggcctgtcaggcagtggtgcgtttttctaccgctattgaggtaggtcaatttgcgaaggcggattattttgtggcaaacagatgttctttttgatttcgcgcaaaaagattcagaattttactgttagtttcctcgcgcagtaatacccctgaaaaaagaggaaagcaatggacgtcagtcgcagacaattttttaaaatctgcgcgggcggtatggctggaacaacagtagcggcattgggctttgccccgaagcaagcactggctcaggcgcgaaactacaaattattacgcgctaaagagatccgtaacacctgcacatactgttccgtaggttgcgggctattgatgtatagcctgggtgatggcgcaaaaaacgccagagaagcgatttatcacattgaaggtgacccggatcatccggtaagccgtggtgcgctgtgcccgaaaggggccggtttgctggattacgtcaacagtgaaaaccgtctgcgctacccggaatatcgtgcgccaggttctgacaaatggcagcgcattagctgggaagaagcattctcccgtattgcgaagctgatgaaagctgaccgtgacgctaactttattgaaaagaacgagcagggcgtaacggtaaaccgttggctttctaccggtatgctgtgtgcctccggtgccagcaacgaaaccgggatgctgacccagaaatttgcccgctccctcgggatgctggcggtagacaaccaggcgcgcgtctgacacggaccaacggtagcaagtcttgctccaacatttggtcgcggtgcgatgaccaaccactgggtggatatcaaaaacgctaacgtcgtgatggtgatgggcggtaacgctgctgaagcgcatcccgtcggtttccgctgggcgatggaagcgaaaaacaacaacgacgcaaccttgatcgttgtcgatccccgttttacgcgtaccgcttctgtggcggatatttacgcgcctattcgttccggtacggacattacgttcctgtctggcgttttgcgctacctgatcgaaaacaacaaaatcaacgccgaatacgttaagcattacaccaacgccagcctgctggtgcgtgatgattttgctttcgaagacggtctgttcagcggctacgacgctgaaaaacgtcaatacgataaatcgtcctggaactatcagctcgatgaaaacggctatgcgaaacgcgatgaaacactgactcatccgcgctgtgtgtggaacctgctgaaagagcacgtttcccgctacacgccggacgtcgttgaaaaca

(The sequence listing continues in the following parts.)

We claim:

1. A non-naturally occurring *Escherichia coli* (*E. coli*) bacterium having a genome between 4.41 Mb and 2.78 Mb and lacking CP4-6, DLP12, λ*B, RybB*B, e14, Rac, Qin, CP4-44, PR-X, KpLE1, CPZ-55, CP4-57, PheV*B, SelC*B, and KpLE2 prophage elements.

2. The bacterium of claim 1, wherein the bacterium additionally lacks all IS1, IS2, IS3, IS5, IS150 and IS186 insertion sequences.

3. The bacterium of claim 1, wherein the parent strain of said bacterium is a K12 or B strain.

4. The bacterium of claim 3, wherein the parent strain of said bacterium is K12 strain MG1655.

5. The bacterium of claim 3, wherein the parent strain of said bacterium is B strain BL21(DE3).

6. The bacterium of claim 1, wherein the bacterium comprises a vector.

7. The bacterium of claim 6, wherein the vector comprises a nucleic acid encoding a polypeptide and wherein the nucleic acid is operatively linked to an expression control sequence.

8. The bacterium of claim 7, wherein the vector is a plasmid.

9. A method of producing a polypeptide comprising culturing a bacterium according to claim 7 under suitable conditions to allow expression of the polypeptide and collecting the polypeptide.

10. The bacterium of claim 4, wherein the genome of the bacterium is lacking at least the nucleic sequences set forth in Table 1.

11. The bacterium of claim 1, wherein the chromosome of the bacterium does not comprise scars.

* * * * *